(12) United States Patent
Grant et al.

(10) Patent No.: US 10,251,921 B2
(45) Date of Patent: Apr. 9, 2019

(54) COMPOSITIONS COMPRISING BACTERIAL STRAINS

(71) Applicant: 4D Pharma Research Limited, Aberdeen (GB)

(72) Inventors: George Grant, Aberdeen (GB); Angela Margaret Patterson, Norwich (GB); Imke Mulder, Aberdeen (GB); Seanin McCluskey, Aberdeen (GB); Emma Raftis, Leeds (GB)

(73) Assignee: 4D PHARMA RESEARCH LIMITED (GB)

( * ) Notice: Subject to any disclaimer, the term of this patent is extended or adjusted under 35 U.S.C. 154(b) by 0 days.

(21) Appl. No.: 15/673,270

(22) Filed: Aug. 9, 2017

(65) Prior Publication Data

US 2017/0360856 A1    Dec. 21, 2017

Related U.S. Application Data

(63) Continuation of application No. PCT/GB2016/051770, filed on Jun. 15, 2016.

(30) Foreign Application Priority Data

Jun. 15, 2015  (GB) .................................. 1510466.4
Nov. 20, 2015  (GB) .................................. 1520508.1
Apr. 19, 2016  (GB) .................................. 1606810.8

(51) Int. Cl.
| | |
|---|---|
| *A61K 35/747* | (2015.01) |
| *C07K 14/54* | (2006.01) |
| *C07K 16/24* | (2006.01) |
| *A61K 38/00* | (2006.01) |
| *A61K 35/74* | (2015.01) |
| *C12R 1/01* | (2006.01) |

(52) U.S. Cl.
CPC ............ *A61K 35/747* (2013.01); *A61K 35/74* (2013.01); *C07K 14/54* (2013.01); *C07K 16/24* (2013.01); *C12R 1/01* (2013.01); *A61K 38/00* (2013.01)

(58) Field of Classification Search
None
See application file for complete search history.

(56) References Cited

U.S. PATENT DOCUMENTS

| | | | |
|---|---|---|---|
| 5,589,168 A | 12/1996 | Allen et al. | |
| 7,749,494 B2 | 7/2010 | Renaud et al. | |
| 7,998,474 B2 | 8/2011 | Kelly | |
| 8,460,648 B2 | 6/2013 | Borody | |
| 9,011,834 B1 | 4/2015 | McKenzie et al. | |
| 9,314,489 B2 | 4/2016 | Kelly et al. | |
| 9,371,510 B2 | 6/2016 | Moore | |
| 9,376,473 B2 | 6/2016 | Gleiberman et al. | |
| 9,539,293 B2 | 1/2017 | Kelly et al. | |
| 9,610,307 B2 * | 4/2017 | Berry .................. A61K 9/0031 |
| 9,662,381 B2 | 5/2017 | Honda et al. | |
| 9,796,762 B2 | 10/2017 | Kelly et al. | |
| 9,808,519 B2 | 11/2017 | Honda et al. | |
| 9,839,655 B2 | 12/2017 | Mulder et al. | |
| 9,974,815 B2 | 5/2018 | Mulder et al. | |
| 9,987,311 B2 | 6/2018 | Mulder et al. | |
| 10,046,015 B2 | 8/2018 | Mulder et al. | |
| 10,058,574 B2 | 8/2018 | Grant et al. | |
| 10,080,772 B2 | 9/2018 | Crouzet et al. | |
| 10,086,020 B2 | 10/2018 | Bernalier-Donadille et al. | |
| 10,086,021 B2 | 10/2018 | Jeffery et al. | |
| 10,086,022 B2 | 10/2018 | Bernalier-Donadille et al. | |
| 10,086,023 B2 | 10/2018 | Bernalier-Donadille et al. | |
| 2003/0147858 A1 | 8/2003 | Renaud et al. | |
| 2008/0069861 A1 | 3/2008 | Brown et al. | |
| 2010/0284973 A1 | 11/2010 | Schiffer-Mannioui et al. | |
| 2010/0303782 A1 | 12/2010 | Cobb et al. | |
| 2010/0311686 A1 | 12/2010 | Kasper et al. | |
| 2010/0316617 A1 | 12/2010 | Renaud et al. | |
| 2013/0195802 A1 | 8/2013 | Moore | |
| 2014/0037716 A1 | 2/2014 | Nowill et al. | |
| 2014/0147425 A1 | 5/2014 | Henn et al. | |
| 2014/0154218 A1 | 6/2014 | Kohno et al. | |
| 2014/0199281 A1 | 7/2014 | Henn et al. | |
| 2014/0335131 A1 | 11/2014 | Mazmanian et al. | |
| 2014/0341921 A1 | 11/2014 | Honda et al. | |
| 2015/0071957 A1 | 3/2015 | Kelly et al. | |
| 2015/0104418 A1 | 4/2015 | Flint et al. | |
| 2016/0067188 A1 | 3/2016 | Cade et al. | |
| 2016/0199424 A1 | 7/2016 | Berry et al. | |
| 2016/0279177 A1 | 9/2016 | Kelly et al. | |
| 2017/0143772 A1 | 5/2017 | Mulder et al. | |

(Continued)

FOREIGN PATENT DOCUMENTS

| | | |
|---|---|---|
| CN | 101590081 A | 12/2009 |
| CN | 102940652 A | 2/2013 |

(Continued)

OTHER PUBLICATIONS

Chiu, et al., Monocolonization of germ-free mice with bacteroides fragilis protects against dectran sulfate sodium-induced acute colitis. Biomed Research International 2014. vol. 2014. Article ID 675786. 9 Pages.

Fenner, et al., *Bacteroides massiliensis* sp. nov., isolated from blood culture of a newborn. International Journal of systematic and evolutionary microbiology, 2005. 55: 1335-1337.

Hougee, et al., Oral treatment with probiotics reduces allergic symptoms in ovalbumin-sensitized mice:a bacterial strain comparative study. Int Arch Allergy Immunol. 2010; 151:107-117.

Lyons, et al., Bacterial strain-specific induction of Foxp3 T regulatory cells is protective in murine allergy models. Clinical & Experimental Allergy. 2010; 40:811-819.

(Continued)

*Primary Examiner* — Robert A Zeman
(74) *Attorney, Agent, or Firm* — Wilson Sonsini Goodrich & Rosati

(57) ABSTRACT

The invention provides compositions comprising bacterial strains for treating and preventing inflammatory and autoimmune diseases.

14 Claims, 76 Drawing Sheets

Specification includes a Sequence Listing.

(56) References Cited

U.S. PATENT DOCUMENTS

| | | |
|---|---|---|
| 2017/0143773 A1 | 5/2017 | Mulder et al. |
| 2017/0143774 A1 | 5/2017 | Mulder et al. |
| 2017/0143775 A1 | 5/2017 | Mulder et al. |
| 2017/0173089 A1 | 6/2017 | Kelly |
| 2017/0354695 A1 | 12/2017 | Grant et al. |
| 2018/0133265 A1 | 5/2018 | Stevenson |

FOREIGN PATENT DOCUMENTS

| | | |
|---|---|---|
| CN | 103156888 A | 6/2013 |
| CN | 103981115 A | 8/2014 |
| CN | 102940652 B | 3/2015 |
| CN | 104546932 A | 4/2015 |
| CN | 104546933 A | 4/2015 |
| CN | 104546934 A | 4/2015 |
| CN | 104546935 A | 4/2015 |
| CN | 104546940 A | 4/2015 |
| CN | 104546942 A | 4/2015 |
| EP | 1448995 A1 | 8/2004 |
| EP | 2687227 A1 | 1/2014 |
| EP | 2810652 A2 | 12/2014 |
| EP | 2832859 A1 | 2/2015 |
| JP | H08259450 A | 10/1996 |
| JP | 2003261453 A | 9/2003 |
| JP | 2005097280 A | 4/2005 |
| JP | 2007084533 A | 4/2007 |
| JP | 2007116991 A | 5/2007 |
| JP | 2009507023 A | 2/2009 |
| JP | 2010246523 A | 11/2010 |
| JP | 5183848 B2 | 4/2013 |
| JP | 2013527240 A | 6/2013 |
| JP | 2015500792 A | 1/2015 |
| KR | 20100128168 A | 12/2010 |
| WO | WO-9919459 A1 | 4/1999 |
| WO | WO-0185187 A1 | 11/2001 |
| WO | WO-03046580 A1 | 6/2003 |
| WO | WO-2007027761 A2 | 3/2007 |
| WO | WO-2007136719 A2 | 11/2007 |
| WO | WO-2009027753 A1 | 3/2009 |
| WO | WO-2009072889 A1 | 6/2009 |
| WO | WO-2009154463 A2 | 12/2009 |
| WO | WO-2011110918 A1 | 9/2011 |
| WO | WO-2011149335 A1 | 12/2011 |
| WO | WO-2011152566 A2 | 12/2011 |
| WO | WO-2011153226 A2 | 12/2011 |
| WO | WO-2012024638 A2 | 2/2012 |
| WO | WO-2011153226 A3 | 3/2012 |
| WO | WO-2012142605 A1 | 10/2012 |
| WO | WO-2013008039 A2 | 1/2013 |
| WO | WO-2013037068 A1 | 3/2013 |
| WO | WO-2013050792 A1 | 4/2013 |
| WO | WO-2013053836 A1 | 4/2013 |
| WO | WO-2013080561 A1 | 6/2013 |
| WO | WO-2014001368 A1 | 1/2014 |
| WO | WO-2014067976 A1 | 5/2014 |
| WO | WO-2014075745 A1 | 5/2014 |
| WO | WO-2014078911 A1 | 5/2014 |
| WO | WO-2014121298 A2 | 8/2014 |
| WO | WO-2014121304 A2 | 8/2014 |
| WO | WO-2014137211 A1 | 9/2014 |
| WO | WO-2014145958 A2 | 9/2014 |
| WO | WO-2014167338 A1 | 10/2014 |
| WO | WO-2014201037 A2 | 12/2014 |
| WO | WO-2015006355 A2 | 1/2015 |
| WO | WO-2015013214 A2 | 1/2015 |
| WO | WO-2015021936 A1 | 2/2015 |
| WO | WO-2015095241 A2 | 6/2015 |
| WO | WO-2015156419 A1 | 10/2015 |
| WO | WO-2015156519 A1 | 10/2015 |
| WO | WO-2015169944 A1 | 11/2015 |
| WO | WO-2016019506 A1 | 2/2016 |
| WO | WO-2016033439 A2 | 3/2016 |
| WO | WO-2016057671 A1 | 4/2016 |
| WO | WO-2016102950 A1 | 6/2016 |
| WO | WO-2016102951 A1 | 6/2016 |
| WO | WO-2017148596 A1 | 9/2017 |
| WO | WO-2018011594 A1 | 1/2018 |

OTHER PUBLICATIONS

Macsharry et al., Immunomodulatory effects of feeding with bifidobacterium longum on allergen-induced lung inflammation in the mouse. Pulmonary pharmacology & Therapeutics. 2012; 25:325-334.

Miyake, et al., Phylogenetic analysis of the genus *Bifidobacterium* and related genera based on 16S rDNA sequences. Microbiol. Immunol. 1998; 42(10): 661-667.

Miyauchi, E., Control of multiple sclerosis by gut microbiota. Journal of clinical and experimental medicine. 2015. vol. 253 No. 5.2, pp. 445-450.

Notice of Allowance dated Nov. 22, 2017 for U.S. Appl. No. 15/359,988.

Office Action dated Nov. 2, 2017 for U.S. Appl. No. 15/700,007.

Office Action dated Nov. 24, 2017 for U.S. Appl. No. 15/359,972.

Office Action dated Nov. 24, 2017 for U.S. Appl. No. 15/679,857.

Office Action dated Dec. 6, 2017 for U.S. Appl. No. 15/592,178.

Parabacteroides distasonis (Eggerth and Gagnon) Sakamoto and Benno (ATCC 8503). Sep. 19, 2017. 2 Pages.

Sagar, et al., Bifidobacterium breve and lactobacillus rhamnosus treatment is as effective as budesonide at reducing inflammation in a murine model for chronic asthma. Respiratory Research. 2014; 15(46):1-17.

Schouten, et al., Cow milk allergy symptoms are reduced in mice fed dietary synbiotics during oral sensitization with whey. Nutritional Immunology. 2015; 139(7):1390-403.

Tanaka, K. and Watanabe, K., In Vitro tebipenem activity against anaerobic bacteria. Japanese Journal of Chemotherapy. Mar. 2009. vol. 57 S-1.

Van De Veerdonk, et al., The Anti-CD20 antibody rituximab reduces the Th17 cell response. Arthritis & Rheumatism. Jun. 2011; 63(6):1507-1516.

Zhu, S. and Qian, Y., IL-17/IL-17 receptor system in autoimmune disease: mechanisms and therapeutic potential. Clinical Science (2012) 122, 487-511.

"Amedei, A. et al. Multiple sclerosis: the role of cytokines in pathogenesis and in therapies. Int J Mol Sci. Oct. 19, 2012;13(10):13438-60. doi: 10.3390/ijms131013438."

Arenberg, et al., Interferon-γ-inducible Protein 10 (IP-10) Is an Angiostatic Factor That Inhibits Human Non-small Cell Lung Cancer (NSCLC) Tumorigenesis and Spontaneous Metastases. 1996. J. Exp.Med. 184:981-92.

Atarashi et al., Th17 Cell Induction by Adhesion of Microbes to Intestinal Epithelial Cells. Cell, vol. 163, No. 2, Oct. 8, 2015. pp. 367-380.

Atarashi, K. et al., Treg induction by a rationally selected mixture of Clostridia strains from the human microbiota. Nature. 2013; 500(7461):232-236.

Atlas, R. Handbook of Microbiological Media, Fourth Edition. CRC Press. 2010.

Ausubel, et al. Current Protocols in Molecular Biology. 1987. Supplement 30.

Ausubel et al., Short protocols in molecular biology. Fifth edition, 2002.

Azad, M.B. et al., Probiotic supplementation during pregnancy or infancy for the prevention of asthma and wheeze: systematic review and meta-analysis BMJ 2013; 347 :f6471.

Bagge, et al., Diversity of spore-forming bacteria in cattle manure, slaughterhouse waste and samples from biogas plants. Journal of applied microbiology. 2010;109: 1549-1565.

Balato, et al., Effects of adalimumab therapy in adult subjects with moderate-to-severe psoriasis on Th17 pathway. (2014) J Eur Acad Dermatol Venereol. 28(8):1016-24.

Bertram, J. et al. Establishment of a cloned line of Lewis lung carcinoma cells adapted to cell culture. (1980) Cancer let. 11:63-73.

Birdi, K.S. Handbook of Surface and Colloid Chemistry, 2nd Edition. CRC Press. 1997.

(56) References Cited

OTHER PUBLICATIONS

Bottacini, et al., Comparative genomics of the Bifidobacterium brevetaxon. BMC Genomics, 2014; 15:170. DOI:10.1186/1471-1471-2164-15-170.
Brand et al., Collagen-induced arthritis, 2007; Protocol 2(5):1269-1275.
Busing, K. et al., Effects of oral Enterococcus faecium strain DSM 10663 NCIMB 10415 on diarrhoea patterns and performance of sucking piglets. Benef Microbes. Mar. 2015;6(1):41-4. doi: 10.3920/BM2014.0008.
"Campeau, J.L. et al., Intestinal Epithelial Cells Modulate Antigen-Presenting Cell Responses to Bacterial DNA. Infectionand Immunity. Aug. 2012; 80(8): 2632-2644."
Caspi, P.R. Experimental autoimmune uveoretinitis in the rat and mouse. Curr Protoc Immunol. May 2003;Chapter 15:Unit 15.6. doi: 10.1002/0471142735.im1506s53.
Cheluvappa, R. et al., T helper type 17 pathway suppression by appendicitis and appendectomy protects against colitis. Clin Exp Immunol. Feb. 2014;175(2):316-22. doi: 10.1111/cei.12237.
Chen, S. et al., Live combined bacillus subtilis and enterococcus faecium ameliorate murine experimental colitis by immunosuppression. International journal of inflammation. 2014(878054). 7 Pages.
Chi, W. et al., IL-23 promotes CD4+ T cells to produce IL-17 in Vogt-Koyanagi-Harada disease. J Allergy Clin Immunol. May 2007;119(5):1218-24. Epub Mar. 1, 2007.
Chi, W. et al. Upregulated IL-23 and IL-17 in Behçet patients with active uveitis. Invest Ophthalmol Vis Sci. Jul. 2008;49(7):3058-64. doi: 10.1167/iovs.07-1390.
Collins, M.D., et al., *Enterococcus avium* nom. rev., comb. nov.; *E. casseliflavus* nom. rev., comb. nov.; *E. durans* nom. rev., comb. nov.; *E. gallinarum* comb. nov.; and *E. malodoratus* sp. nov. (1984) Int J Syst Evol Microbiol. 34: 220-223.
Co-pending U.S. Appl. No. 15/592,178, filed May 10, 2017.
Co-pending U.S. Appl. No. 15/631,945, filed Jun. 23, 2017.
Co-pending U.S. Appl. No. 15/631,952, filed Jun. 23, 2017.
Co-pending U.S. Appl. No. 15/679,857, filed Aug. 17, 2017.
Co-pending U.S. Appl. No. 15/700,007, filed Sep. 8, 2017.
Dahya V. et al., Clostridium ramosum Osteomyelitis in an immunocompetent patient after traumatic injury, Infectious Diseases in Clinical Practice 20150312 Lippincott Williams and Wilkins USA, vol. 23, No. 2, Mar. 12, 2015, pp. 102-104, XP009193312, ISSN: 1056-9103 the whole document.
Darlington, G.J., Liver Cell Lines. (1987) Meth Enzymol. 151:19-38.
Day, J.G. et al., Cryopreservation and Freeze-Drying Protocols. Springer. 2007. 2nd edition.
Divyashri et al. Probiotic attributes, antioxidant, anti-inflammatory and neuromodulatory effects of Enterococcus faecium CFR 3003: in vitro and in vivo evidence. (2015) J Med Microbiol. doi: 10.1099/jmm.0.000184.
Duncan et al. (2002) "*Roseburia intestinal* is sp. nov., a novel saccharolytic, butyrate-producing bacterium from human faeces," International Journal System Evolutionary Microbiology. 52:1615-1620.
Duncan et al. (2006) "Proposal of *Roseburia faecis* sp. nov., *Roseburia hominis* sp. nov. and *Roseburia inulinivorans* sp. nov., based on isolates from human faeces," International Journal of Systematic and Evolutionary Microbiology. vol. 56, No. Pt 10, pp. 2437-2441.
Eckburg, PB. et al., Diversity of the human intestinal microbial flora.Science. Jun. 10, 2005;308(5728):1635-8. Epub Apr. 14, 2005.
Fabro, A. et al., The Th17 pathway in the peripheral lung microenvironment interacts with expression of collagen V in the late state of experimental pulmonary fibrosis. (2015) Immunobiology. 220(1):124-35.
Faghih, Z. et a., IL-17 and IL-4 Producing CD8+ T Cells in Tumor Draining Lymph Nodes of Breast Cancer Patients: Positive Association with Tumor Progression. (2013). Iranian Journal of Immunology. 10(4):193-204.

Fahy, J.V. Eosinophilic and neutrophilic inflammation in asthma: insights from clinical studies. Proc Am Thorac Soc. May 1, 2009;6(3):256-9. doi: 10.1513/pats.200808-087RM.
Farooq, P.D. et al., Pseudomembranous colitis, Disease-A-Month 2015 Mosby Inc. USA, vol. 61, No. 5, May 1, 2015, pp. 181-206, XP009193313, ISSN: 0011-5029 p. 195.
FDA Orphan Drug Designations. Total Orphan Drugs website. Aug. 2014. Available at http://www.orphan-drugs.org/2014/09/01/fda-orphandrug-designations-august-2014. Accessed on Apr. 13, 2016.
Frank, D. et al., Molecular-phylogenetic characterization of microbial community imbalances in human inflammatory bowel diseases. 2007. PNAS. 104(34):13780-5.
GB Exam and search report dated Aug. 30, 2016 for GB Application No. 1520638.6.
GB Search and Exam report dated Mar. 31, 2016 for GB application 1510469.8.
GB Search and Exam report dated Mar. 31, 2016 for GB application 1510470.6.
GB Search and Exam report dated Apr. 15, 2016 for GB application 1510467.2.
GB Search and Exam report dated Apr. 20, 2016 for GB application 1510466.4.
GB Search and Exam report dated Apr. 20, 2016 for GB application 1510468.0.
GB Search and Exam report dated Aug. 30, 2016 for GB application no. 1520631.1.
GB Search and Exam report dated Nov. 17, 2016 for GB application 1520502.4.
GB Search and Exam report dated Sep. 13, 2016 for GB application 1520497.7.
Gennaro, A.R., Remington's Pharmaceutical sciences, Mack publishin co. 1985.
Gennaro, A.R., Remington: The Science and practice of pharmacy. 20th edition. 2000.
Ghadimi, D. et al., Epigenetic imprinting by commensal probiotics inhibits the IL-23/IL-17 axis in an in vitro model of the intestinal mucosal immune system. JLB. 2012;92(4):895-911.
Goldin, B.R. et al., Clinical indications for probiotics: an overview. Clin Infect Dis. Feb. 1, 2008;46 Suppl 2:S96-100; discussion S144-51. doi: 10.1086/523333.
Guide for the care and use of laboratory animals: 8th edition. The national academic press; 2011.
Haabeth et al. A model for cancer-suppressive inflammation. (2012) OncoImmunology 1(1):1146-1152.
Hammerich, L. et al., Interleukins in chronic liver disease: lessons learned from experimental mouse models. (2014) Clin Exp Gastroenterol. 7:297-306.
Holdeman, et al., *Eubacterium contortum* (Prevot) comb. nov.: Emendation of description and designation of the type strain. International journal of systematic bacteriology. Oct. 1971;21(4): 304-306.
International Search Report dated Jan. 27, 2017 for International Application No. PCT/GB2016/053622.
International Search Report dated Feb. 17, 2017 for International Application No. PCT/GB2016/053676.
International Search Report dated Aug. 26, 2016 for International application No. PCT/GB2016/051774.
International Search Report dated Aug. 26, 2016 for International application No. PCT/GB2016/051776.
International Search Report dated Sep. 6, 2016 for International application No. PCT/GB2016/051768.
International Search Report dated Sep. 6, 2016 for International application No. PCT/GB2016/051773.
International Search Report dated Sep. 6, 2016 for International application No. PCT/GB2016/051770.
International Search Report dated Feb. 2, 2017 for International application No. PCT/GB2016/053620.
International Search Report dated Mar. 6, 2017 for International Application No. PCT/GB2016/053677.
Ispirli, H. et al., Characterization of functional properties of Enterococcus faecium strains isolated from human gut.Can. J. Microbiol. 61: 861-870 (2015) dx.doi.org/10.1139/cjm-2015-0446.

(56) References Cited

OTHER PUBLICATIONS

Jawad, S. et al., Elevated serum levels of interleukin-17A in uveitis patients. Ocul Immunol Inflamm. Dec. 2013;21(6):434-9. doi: 10.3109/09273948.2013.815786. Epub Aug. 19, 2013.
Jiao et al., Blockade of Notch Signaling Ameliorates Murine Collagen-Induced Arthritis via Suppressing Th1 and Th17 Cell Responses. 2014; Pathology, 184(4):1085-1091.
Kailasapathy, K. Microencapsulation of Probiotic Bacteria:Technology and Potential Applications. Curr. Issues Intest. Microbiol. (2002) 3: 39-48.
Kanauchi, et al., Eubacterium limosum ameliorates experimental colitis and metabolite of microbe attenuates colonic inflammatory action with increase of mucosal integrity introduction, China World J Gastroenterol February, Jan. 1, 2006. pp. 1071-1077.
Kang, S. et al., Dysbiosis of fecal microbiota in Crohn's disease patients as revealed by a custom phylogenetic microarray.Inflamm Bowel Dis. Dec. 2010;16(12):2034-42. doi: 10.1002/ibd.21319.
Karaffova, et al., Interaction of TGF-B4 and IL-17 with IgA secretion in the intestine of chickens fed with E. faecium AL41 and challenged with S. Enteritidis. Research in Veterinary science. 2015:75-79.
Karin, M. Nuclear factor-kappaB in cancer development and progression. Nature. May 25, 2006;441(7092):431-6.
Kitahara, M. et al., *Bacteroides plebeius* sp. nov. and *Bacteroides coprocola* sp. nov., isolated from human faeces. International journal of systematic and evolutionary microbiology. 2005; 55: 2143-2147.
Koenders, M.I. et al., Interleukin-17 Acts Independently of TNF-a under Arthritic Conditions. (2006) J. Immunol. 176:6262-6269.
Kverka, M. et al., Oral administration of Parabacteroides distasonis antigens attenuates experimental murine colitis through modulation of immunity and microbiota composition. Clinical & Experimental Immunology. 2010; 163:250-259.
Laukova, A. et al. Benefits of Combinative Application of Probiotic, Enterocin M-Producing Strain Enterococcus Faecium AL41 and Eleutherococcus Senticosus in Rabbits. Folia Microbiol (Praha) 61 (2), 169-177. Sep. 9, 2015.
Lejeune, FJ. et al., Efficiency of Recombinant Human TNF in Human Cancer Therapy. (2006) Cancer Immun. 6:6.
Leslie, et al., Trehalose and sucrose protect both membranes and proteins in intact bacteria during drying. (1995) Appl. Environ. Microbiol. 61, 3592-3597.
Lodemann, U. et al., Effects of the Probiotic enterococcus faecium and pathogenic *Escherichia coli* strains in a pig and human epithelial intestinal cell model. Hindawi publishing corporation scientifica. 2015(235184) 10 pages.
Luger, D. and Caspi, R.R., New perspectives on effector mechanisms in uveitis. (2008) Semin. Immunopathol. 30(2): 134-143.
Machiels, K. A decrease of the butyrate-producing species *Roseburia hominis* and Faecalibacterium prausnitzii defines dysbiosis in patients with ulcerative colitis.Gut. Aug. 2014;63(8):1275-83. doi: 10.1136/gutjnl-2013-304833. Epub Sep. 10, 2013.
Macpherson, AJ. et al., IgA responses in the intestinal mucosa against pathogenic and non-pathogenic microorganisms. Oct. 2001. 3(12). 1021-1035.
Macpherson, AJ., et al., The functions of mucosal T cells in containing the indigenous commensal flora of the intestine.Cell Mol Life Sci. Dec. 2002;59(12):2088-96.
Manni et al., A tale of two cytokines: IL-17 and IL-22 in asthma and infection. Expert Rev Respir Med. Feb. 2014; 8(1): 25-42. doi:10.1586/17476348.2014.854167.
Mansour et al. Isolation of Enterococcus faecium NM113, Enterococcus faecium NM213 and Lactobacillus casei NM512 as novel probiotics with immunomodulatory properties. (2014) Microbiol Immunol. 58(10):559-69.
Masco, L., et al., Identification of *Bifidobacterium* Species Using rep-PCR Fingerprinting. Systematic and Applied Microbiology 26(4):557-63 Dec. 2003.

Maya, J.R. et al., Emerging Therapies for Noninfectious Uveitis: What May Be Coming to the Clinics. (2014) J. Ophthalmology. 310329.
Mazmanian, SK., An immunomodulatory molecule of symbiotic bacteria directs maturation of the host immune system.Cell. Jul. 15, 2005;122(1):107-18.
Miossec et al., Targeting IL-17 and TH17 cells in chronic inflammation, 2012; Nature Drug Discovery 11, 763-776.
Miossec, P. et al. Targeting IL-17 and TH17 cells in chronic inflammation. Nat Rev Drug Discov. Oct. 2012;11(10):763-76. doi: 10.1038/nrd3794.
Mitropoulou, G. et al. Immobilization Technologies in Probiotic Food Production. (2013) Journal Nutr Metab. (2013) 716861.
Miyake, T. et al., Phylogenetic Analysis of the Genus *Bifidobacterium* and Related Genera Based on 16S rDNA Sequences. Microbiol. Immunol. 1998; 42(10):661-667.
Miyamoto-Shinohara, Y. et al., Survival of freeze-dried bacteria. J Gen Appl Microbiol. Feb. 2008;54(1):9-24.
Monteleone, I. et al., Th17-related cytokines: new players in the control of chronic intestinal inflammation. (2011) BMC Medicine. 2011, 9:122.
Mucientes, A. et al., Specific association of IL17A genetic variants with panuveitis. (2015) Br J Ophthalmol. 99(4):566-70.
Mukai et al., SH3BP2 Gain-Of-Function Mutation Exacerbates Inflammation and Bone Loss in a Murine Collagen-Induced Arthritis Model, 2014 PLoS One 9(8): e105518.
Notice of allowance dated Sep. 1, 2017 for U.S. Appl. No. 15/357,850.
Numasaki, M. et al., IL-17 Enhances the Net Angiogenic Activity and In Vivo Growth of Human Non-Small Cell Lung Cancer in SCID Mice through Promoting CXCR-2-Dependent Angiogenesis. (2005) J. Immunol. 175: 6177-6189.
Numasaki, M. et al., Interleukin-17 promotes angiogenesis and tumor growth. Blood. Apr. 1, 2003;101(7):2620-7. Epub Oct. 31, 2002.
Office Action dated Jan. 11, 2005 for U.S. Appl. No. 10/285,224.
Office Action dated Jan. 26, 2009 for U.S. Appl. No. 10/275,706.
Office Action dated Feb. 18, 2010 for U.S. Appl. No. 10/285,224.
Office Action dated Mar. 13, 2013 for U.S. Appl. No. 12/760,926.
Office Action dated Mar. 26, 2007 for U.S. Appl. No. 10/275,706.
Office Action dated Apr. 4, 2008 for U.S. Appl. No. 10/285,224.
Office Action dated May 2, 2007 for U.S. Appl. No. 10/285,224.
Office Action dated May 2, 2008 for U.S. Appl. No. 10/275,706.
Office Action dated May 25, 2016 for U.S. Appl. No. 14/249,710.
Office Action dated May 26, 2009 for U.S. Appl. No. 10/285,224.
Office Action dated May 26, 2017 for U.S. Appl. No. 15/357,850.
Office Action dated May 30, 2006 for U.S. Appl. No. 10/285,224.
Office Action dated Jun. 26, 2017 for U.S. Appl. No. 15/357,936.
Office Action dated Jul. 6, 2017 for U.S. Appl. No. 15/070,605.
Office action dated Jul. 8, 2015 for U.S. Appl. No. 14/349,907.
Office Action dated Jul. 31, 2017 for U.S. Appl. No. 15/359,988.
Office Action dated Aug. 10, 2017 for U.S. Appl. No. 15/357,850.
Office Action dated Aug. 21, 2013 for U.S. Appl. No. 12/760,926.
Office Action dated Sep. 4, 2015 for U.S. Appl. No. 14/249,710.
Office Action dated Sep. 17, 2010 for U.S. Appl. No. 10/285,224.
Office Action dated Oct. 12, 2005 for U.S. Appl. No. 10/285,224.
Office Action dated Oct. 28, 2009 for U.S. Appl. No. 10/275,706.
Office Action dated Oct. 30, 2008 for U.S. Appl. No. 10/285,224.
Office Action dated Nov. 6, 2006 for U.S. Appl. No. 10/285,224.
Office Action dated Nov. 23, 2015 for U.S. Appl. No. 14/232,475.
Office Action dated Dec. 13, 2012 for U.S. Appl. No. 12/760,926.
Office Action dated Dec. 19, 2005 for U.S. Appl. No. 10/275,706.
Overstreet et al. 'Dysbiosis Characterized by Reduced Abundance of Roseburia is Associated With Increased Severity of Colitis in IL-10-/- Mice'. Gastroenterology. 2011, vol. 140, No. 5, Suppl. 1, pp. S-696.
Pace et al. Macrophage activiation: Priming activity from a T-cell hybridoma is attributable to interferon. (1983) PNAS. 80:3782-6.
Park, S.K. et al., *Blautia stercoris* sp. nov., isolated from human faeces. International journal of systematic and evolutionary microbiology. 2012; 62(4): 776-779.

(56) References Cited

OTHER PUBLICATIONS

Patel., R. et al., Determination of 16S rRNA sequences of enterococci and application to species identification of nonmotile enterococcus gallinarum isolates. Journal of clinical microbiology, 1998; 36(11):3399-3407.
Rockwell, S.C. et al., Characteristics of a Serially Transplanted Mouse Mammary Tumor and Its Tissue-Culture-Adapted Derivative. (1972) J Natl Cancer Inst. 49:735-49.
Sakamoto, M. et al., Reclassification of Bacteroides distasonis, Bacteroides goldsteinii and Bacteroides merdae as Parabacteroides distasonis gen. nov., comb. nov., Parabacteroides goldsteinii comb. nov. and Parabacteroides merdae comb. nov. International journal of systematic and evolutionary microbiology. 2006; 56: 1599-1605.
Sambrook, J.F. et al., Molecular Cloning: A Laboratory Manual, 3rd ed. Cold spring harbor laboratory press. 2001.
Scanlan PD., et al., Culture-independent analyses of temporal variation of the dominant fecal microbiota and targeted bacterial subgroups in Crohn's disease. J Clin Microbiol. Nov. 2006;44(11):3980-8. Epub Sep. 20, 2006.
Scher et al., Expansion of intestinal Prevotella copri correlates with enhanced susceptibility to arthritis. 2013; eLIFE 2, e01202, 20 Pages.
Schieck, M. et al., Genetic variation in TH17 pathway genes, childhood asthma, and total serum IgE levels.(2014) J Allergy Clin Immunol. 133(3):888-91.
Schleifer, K.H. et al., Transfer of Streptococcus faecalis and Streptococcus faecium to the Genus Enterococcus nom. rev. as Enterococcus faecalis comb. nov. and Enterococcus faecium comb. nov. Int J Syst Evol Microbiol, Jan. 1984 34: 31-34, doi:10.1099/00207713-34-1-31.
Schmitz, S. et al., A prospective, randomized, blinded, placebo-controlled pilot study on the effect of Enterococcus faecium on clinical activity and intestinal gene expression in canine food—responsive chronic enteropathy. J Vet Intern Med. Mar.-Apr. 2015;29(2):533-43. doi: 10.1111/jvim.12563. Epub Mar. 16, 2015.
Schwiertz, et al., Quantification of Different Eubacterium spp. in Human Fecal Samples with Species-Specific 16S rRNA-Targeted Oligonucleotide Probes. Applied and environmental biology, vol. 66, No. 1, Jan. 1, 2000; pp. 375-382.
Severijnen, et al., Chronic Arthritis Induced in Rats by Cell Wall Fragments of Eubacterium Species from the Human Intestinal Flora. Infection and Immunity, Feb. 1990; 58(2): p. 523-528.
Sgadari, C. et al., Interferon-inducible protein-10 identified as a mediator of tumor necrosis in vivo. (1996) PNAS. 93:13791-6.
Sgadari et al. Mig, the Monokine Induced by Interferon-g, Promotes Tumor Necrosis In Vivo. (1997) Blood. 89:2635-43.
Shabgah, A.G. et al., Interleukin-17 in human inflammatory diseases. Postepy Dermatol Alergol. Aug. 2014; 31(4): 256-261.
Simpson-Herren, L. et al., Kinetic parameters and growth curves for experimental tumor systems. Cancer Chemother Rep. Jun. 1970;54(3):143-74.
Sisson, G. et al., Randomised clinical trial: a liquid multi-strain probiotic vs. placebo in the irritable bowel syndrome—a 12 week double-blind study. Aliment Pharmacol Ther. 2014; 40: 51-62.
Sivieri, K. et al., Probiotic enterococcus faecium CRL 183 inhibit chemically induced colon cancer in male wistar rats. Eur Food Res Technol. 2008; 228:231-237.
Smith, T.F. et al., Comparison of biosequences. (1981) Adv. Appl. Math. 2: 482-489.
Song et al., Impact of Schistosoma japonicum Infection on Collagen-Induced Arthritis in DBA/1 Mice: A Murine Model of Human Rheumatoid Arthritis. 2011; PLoS One 6, e23453, 10 pages.
Spor, A. et al., Unravelling the effects of the environment and host genotype on the gut microbiome. Nat Rev Microbiol. Apr. 2011;9(4):279-90. doi: 10.1038/nrmicro2540.
Srutkova, D. et al., Efficiency of PCR-based methods in discriminating Bifidobacterium longum ssp. longum and Bifidobacterium longum ssp. infantis strains of human origin.J Microbiol Methods. Oct. 2011;87(1):10-6. doi: 10.1016/j.mimet.2011.06.014. Epub Jul. 2, 2011.

Stoll et al., Altered microbiota associated with abnormal humoral immune responses to commensal organisms in enthesitis-related arthritis, 2014; Arthritis Res Ther. 16:486.
Strickertsson, J.A. et al., Enterococcus faecalis Infection and Reactive Oxygen Species Down-Regulates the miR-17-92 Cluster in Gastric Adenocarcinoma Cell Culture. Genes 2014, 5(3), 726-738.
Strobel, H.J. Basic laboratory culture methods for anaerobic bacteria. Methods Mol Biol. 2009;581:247-61. doi: 10.1007/978-1-60761-214-8_16.
Sun, D. et al., the role of Th17-associated cytokines in the pathogenesis of experimental autoimmune uveitis (EAU). (2015) Cytokine. 74(1):76-80.
Tesmer, LA. et al., Th17 cells in human disease. Immunol Rev. 2008;223:87-113.
Toomer, O. et al., Maternal and postnatal dietary probiotic supplementation enhances splenic regulatory T helper cell population and reduces peanut allergen-induced hypersensitivity responses in mice. Immunobiology. 209; 2014: 661-670.
Tsukinowa, et al., Fecal microbiota of a dugong (Dugong dugong) in captivity at Toba Aquarium. J. Gen. Appl. Microbiol., 54, 25-38 (2008).
Udayappan, et al., Oral treatment with Eubacterium hallii improves insulin sensitivity in db/db mice. NPJ Biofilms and microbiomes, vol. 2, Jul. 6, 2016; p. 16009.
Udayappan et al., PS4-5. Administration of Eubacterium hallii improves insulin sensitivity and degree of liversteatosis in male db/db mice. Nederlands tijdschrift voor diabetologie, vol. 11, No. 4., Nov. 23, 2013.pp. 145.
Vetrovsky, T. and Baldrian, P., The variability of the 16S rRNA gene in bacterial genomes and its consequences for bacterial community analyses. Plos One. Feb. 2013; 8(2): e57923.
Workman et al. Guidelines for the welfare and use of animals in cancer research (2010) Br. J. Cancer. 102:1555-77.
Wunderlich, P.F. et al., Double-blind report on the efficacy of lactic acid-producing enterococcus SF68 in the prevention of antibiotic-associated diarrhoea and in the treatment of acute diarrhoea. The journal of international medical research. 1989; 17: 333-338.
Yang, J. et al., Targeting Th17 cells in autoimmune diseases. Trends Pharmacol Sci. Oct. 2014;35(10):493-500. doi: 10.1016/j.tips.2014.07.006. Epub Aug. 14, 2014.
Ye, X. et al., The Role of IL-23/Th17 Pathway in Patients with Primary Immune Thrombocytopenia. (2015) PLoS One. 10(1):e0117704.
Yin, X. et al., Combined effect of five single nucleotide polymorphisms related to IL23/Th17 pathway in the risk of psoriasis. Immunogenetics. Mar. 2014;66(3):215-8. doi: 10.1007/500251-013-0756-z. Epub Jan. 14, 2014.
Zhang, B. et al., Oral administration of enterococcus faecalis FK-23 suppresses Th17 cell development and attenuates allergic airway responses in mice. International journal of molecular medicine. 2012; 30:248-254.
Zhang, B. et al., The Prevalence of Th17 Cells in Patients With Gastric Cancer. 2008. Biochem Biophys Res Commun 374 (3), 533-537.
Zhang, et al., The Activation of NF-κB in Infiltrated Mononuclear Cells Negatively Correlates with Treg Cell Frequency in Oral Lichen Planus. Inflammation. Aug. 2015;38(4):1683-9. doi: 10.1007/s10753-015-0145-x.
Zheng, B. et al., Bifidobacteriu breve attenuates murine dextran sodium sulfate-induced colitis and increases regulatory T cell responses. PLOS one. May 2014; 9(5).
Zhongyuan, T. et al., The inflammation regulation effects of enterococcus faecium HDRsEf1 on human enterocyte-like HT-29 cells. Animal cells and systems. Mar. 2016;20(2):70-76.
Zitomersky, N. et al., Characterization of Adherent Bacteroidales from Intestinal Biopsies of Children and Young Adults with Inflammatory Bowel Disease. PLOS one. 2013; 8(6).
Zitvogel, et al., Type I interferons in anticancer immunity. Nature Reviews. Jul. 2015:405-414.
4d Pharma Plc: "Clinical Update—RNS—London Stock Exchange", Jul. 19, 2016.
Anonymous: "4D pharma's Blautix for Irritable Bowel Syndrome shows positive impact—pharmaceutical daily news", Dec. 13, 2016.

(56) References Cited

OTHER PUBLICATIONS

Atarashi, et al., Treg induction by a rationally selected mixture of Clostridia strains from the human microbiota. Supplementary Information. Nature 500, 232-236 (Aug. 8, 2013) doi:10.1038/nature12331.
ATCC Catalog, https://www.atcc.org/search_results.aspx?dsNav=Ntk:primarysearch%7cbacteroides+thetaiotaomicron%7c3c%7c,Ny:true,ro:0,N:1000552searchterms=bacteroides+thetaiotaomicron&redir=1, Accessed on May 2, 2018.
Banfield, J. & Murphy, K.R., Non-Th2, Late-onset, non-allergic asthma. Copd & Asthma for NPs, A peer-reviewed newsletter, Aug. 2016; 14: 8 Pages.
Barry, et al., Criteria for Disksusceptibility tests and quality control guidelines for the cefoperazone-sulbactam combination, Journal of clinical microbiology, Jan. 1988;26(1):13-17.
Berger, S. Gideon guide to medically important bacteria. Gideon E-book Series. 2017 edition. 4 pages.
Bernalier et al. *Ruminococcus hydrogenotrophicus* sp. nov., a new H2/CO2-utilizing acetogenic bacterium isolated from human feces. 1996 Arch. Microbiol. 166 (3), 176-183.
Brook, I., Clinical Review: Bacteremia caused by anaerobic bacteria in children. Critical Care 6(3): 7 pages (2002).
Cekanaviciute, et al., Gut bacteria from multiple sclerosis patients modulate human T cells and exacerbate symptoms in mouse models. PNAS. Jun. 30, 2017; 1-6.
Charriot, et al., Future treatment for ashtma, Eur Respir Rev 2016; 25: 77-92.
Colowick, S. and Kaplan, N., Methods of Enzymology. Academic Press, Inc. 1996.
Co-pending U.S. Appl. No. 15/906,988, filed Feb. 27, 2018.
Co-pending U.S. Appl. No. 15/915,885, filed Mar. 8, 2018.
Co-pending U.S. Appl. No. 15/915,889, filed Mar. 8, 2018.
Co-pending U.S. Appl. No. 15/916,167, filed Mar. 8, 2018.
Co-pending U.S. Appl. No. 15/916,202, filed Mar. 8, 2018.
Co-pending U.S. Appl. No. 15/916,205, filed Mar. 8, 2018.
Co-pending U.S. Appl. No. 15/969,543, filed May 2, 2018.
Demarche, et al., Detailed analysis of sputum and systemic inflammation in asthma phenotypes: are paucigranulocytic asthmatics really non-inflammatory?, BMC Pulmonary Medicine, 2016; (16)46: 1-13.
Distrutti, et al., Gut Microbiota role in irritable bowel syndrome: New therapeutic strategies. World Journal of Gastroenterology. Feb. 21, 2016; 22(7): p. 2219-2241, XP002769875.
Falony, et al., Coculture Fermentations of *Bifidobacterium* species and bacteroides thetaiotaomicron Reveal a mechanistic insight into the prebiotic effect of inulin-type Fructans. Applied and environmental microbiology, Apr. 2009;75(8):2312-2319.
Frick, et al., Identification of commensal bacterial strains that modulate Yersinia enterocolitica and Dextran sodium sulfate-induced inflammatory responses: implications for the development of probiotics. Infection and immunity, Jul. 2007;75(7):3490-3497.
International search report with written opinion dated Feb. 26, 2018 for PCT/GB2017/053722.
Ishikawa, et al., Effect of bifidobacteria to suppress Th17, Food Science and technology institute, 2008, 5 Pages.
Kelly, et al., Commensal gut bacteria: mechanisms of immune modulation. TRENDS in immunology, 2005;26(6):326-333.
Kirsty Minton: Mucosal immunology: The ins and outs of gut inflammation, The journal of immunology, 4(2), Feb. 1, 2004: pp. 81-81, XP055252701.
Kogyo, S. Lactic Acid Bacteria, Intestinal Flora ad Health II; Physiological effects of heat-treated lactococcus "EF-2001" and application to food. Mar. 30, 2001, vol. 44, No. 6, pp. 35-39.
Lee, et al. Intestinal microbiota in pathophysiology and management of irritable bowel syndrome . 2014. World J Gastroenterol. 20(27): 8886-8897.
Liu et al. Reclassification of *Clostridium coccoides, Ruminococcus hansenii, Ruminococcus hydrogenotrophicus, Ruminococcus luti, Ruminococcus productus* and *Ruminococcus schinkii* as *Blautia coccoides* gen. nov., comb. nov., *Blautia hansenii* comb. nov.,
*Blautia hydrogenotrophica* comb. nov., *Blautia luti* comb. nov., *Blautia producta* comb. nov., *Blautia schinkii* comb. nov. and description of *Blautia wexlerae* sp. nov., isolated from human faeces. 2008. Int J Syst Evol Microbiol 58,1896-1902.
Lopetuso et al. Commensal Clostridia: leading players in the maintenance of gut homeostasis. 2013. Gut Pathogens, 5: 23.
Narushima, et al., Characterization of the 17 strains of regulatory T cell-inducing human-derived Clostridia. Gut Microbes Mar. 18, 2014; 5:3, 333-339.
Nuala Moran: 'Microbial wealth', chemistry and industry, 78(6), Jun. 1, 2014, pp. 20-23, XP055252922.
Office Action dated Jan. 2, 2018 for U.S. Appl. No. 15/357,936.
Oladipo, et al., Bioprotective potential of bacteriocinogenic enterococcus gallinarum strains isolated from some Nigerian fermented foods, and of their bacteriocins. Polish Journal of Microbiology. 2014; 63(4): 415-422.
PCT/EP2017/025038 Written Opinion of the International Preliminary Examining Authority dated Jan. 1, 2018.
Pearson, WR. An introduction to sequence similarity ("Homology") searching. Current protocols in bioinformatics/editoral board, Andreas D Baxevanis. [et al]. 2013; 0 3:10. 1002/0471250953. bi0301s42. doi:10.1002/0471250953.bi0301s42.
Robinson, et al. Inside information—The unique features of visceral sensation. 2008. Mol Interv, 8(5): 242-253.
Salix Pharmaceuticals, Inc. FDA Highlights of Prescribing Information—Xifaxan (rifaximin tablet). Revised Nov. 2015.
U.S. Appl. No. 15/915,889 Notice of Allowance dated Jun. 4, 2018.
U.S. Appl. No. 15/700,007 Office Action dated Jun. 1, 2018.
Stanton et al. (1983) "*Roseburia cecicola* gen. nov., sp. nov., a Motile, Obligately Anaerobic Bacterium from a Mouse Cecum," Int. J. Syst. Bacterial. 33:618-627.
Tamanai-Shacoori, et al., *Roseburia* spp.: a marker of health?. Future Microbiology Review 12(2), 157-170 (2017).
Tap et al. Towards the human intestinal microbiota phylogenetic core. 2009. Environ Microbiol, 11(10):2574-84.
U.S. Appl. No. 15/357,936 Notice of Allowance dated Apr. 18, 2018.
U.S. Appl. No. 15/359,988 Notice of Allowance dated Mar. 2, 2018.
U.S. Appl. No. 15/359,988 Notice of Allowance dated Mar. 16, 2018.
U.S. Appl. No. 15/592,178 Notice of Allowance dated Apr. 12, 2018.
U.S. Appl. No. 15/916,202 Notice of Allowance dated Jun. 11, 2018.
U.S. Appl. No. 15/359,144 Office Action dated Apr. 10, 2018.
U.S. Appl. No. 15/359,972 Office Action dated Apr. 4, 2018.
U.S. Appl. No. 15/631,945 Office Action dated Jul. 5, 2018.
U.S. Appl. No. 15/631,945 Office Action dated May 15, 2018.
U.S. Appl. No. 15/631,952 Office Action dated Feb. 16, 2018.
U.S. Appl. No. 15/679,857 Office Action dated Feb. 14, 2018.
U.S. Appl. No. 15/803,723 Notice of Allowance dated Feb. 13, 2018.
Van De Bogert, et al., Immunomodulatory properties of *Streptococcus* and veillonella isolates from the human small intestine microbiota, PLOS One, Dec. 2014: 1-20, D01:10.1371/journal.pone. 0114277.
Wrzosek, et al., Bacteroides thetaiotaomicron and Faecalibacterium prausnitzii influence the production of mucus glycans and the development of globlet cells in the colonic epithelium of a gnotobiotic model rodent. BMC biology, 2013;11(61):1-13.
Xu, et al., The endogenous hydrogen sulfide producing enzyme cystathionine-i synthase contributes to visceral hypersensitivity in a rat model of irritable bowel syndrome. Molecular Pain, Biomed central, London, GB. Aug. 6, 2009; 5(1):p. 44.
Xu, J. et al., "Message from a human gut symbiont: sensitivity is a prerequisite for sharing", Trends in microbiology, 12(1), Jan. 1, 2004: pp. 21-28, XP055253932.
Yu, et al., Utilization of major fucosylated and sialylated human milk oligosaccharides by isolated human gut microbes. Glycobiology, 2013; 23(11):1281-1292.
Zhou et al. Central and peripheral hypersensitivity in the irritable bowel syndrome. 2010. Pain. 148(3): 454-461.

(56) References Cited

OTHER PUBLICATIONS

Buffie et al., Precision microbiome restoration of bile acid-mediated resistance to Clostridium difficile. Nature, 517(7533):205-208 (2015).
Christmann, et al., Human seroreactivity to gut microbiota antigens. J Allergy Clin Immunol 136(5):1378-1386; available online May 23, 2015.
Colin, et al., GIC-1001, a Clinical Stage, Orally Administered Colonic Analgesic Drug Proposed As a Cost-Effective Alternative to I.V. Sedation Used in Colonoscopy. Canadian Digestive Diseases Week, 2014; 2 pages.
Co-pending U.S. Appl. No. 16/022,207, filed Jun. 28, 2018.
Co-pending U.S. Appl. No. 16/022,256, filed Jun. 28, 2018.
Co-pending U.S. Appl. No. 16/022,484, filed Jun. 28, 2018.
Co-pending U.S. Appl. No. 16/022,577, filed Jun. 28, 2018.
Co-pending U.S. Appl. No. 16/031,024, filed Jul. 10, 2018.
Co-pending U.S. Appl. No. 16/040,356, filed Jul. 19, 2018.
Co-pending U.S. Appl. No. 16/100,349, filed Aug. 10, 2018.
Co-pending U.S. Appl. No. 16/147,551, filed Sep. 28, 2018.
Distrutti, et al., 5-Amino-2-hydroxybenzoic Acid 4-(5-Thioxo-5H[1,2]dithiol-3yl)-phenyl Ester (ATB-429), a Hydrogen Sulfide-Releasing Derivative of Mesalamine, Exerts Antinociceptive Effects in a Model of Postinflammatory Hypersensitivity. The Journal of pharmacology and experimental therapeutics, 2006;319(1):447-458.
Farmer, et al., Gut pain & visceral hypersensitivity. British journal of pain, 2013;7(1):39-47.
GB1809729.5 Examination Report dated Oct. 15, 2018.
GenBank Accession No. NR_044054.1 (Feb. 3, 2015) Blautia wexlerae strain SSM 19850 16S ribsomal RNA gene, partial sequence.
GenBank Accession No. NR_117867.1 (Feb. 3, 2015) Blautia stercoris strain GAM6-1 16S ribsomal RNA gene, partial sequence.
Lozupone. Diversity, stability and resilience of the human gut microbiota. 2012. Nature. Sep. 13, 2012; 489 (7415): 220-230.
Sun, et al., Exploring gut microbes in human health and disease: Pushing the envelope. Genes Dis. Dec. 2014; 1(2):132-139.doi:10.1016/j.gendis.2014.08.001.
U.S. Appl. No. 15/592,178 Notice of Allowance dated Jul. 12, 2018.
U.S. Appl. No. 15/631,945 Notice of Allowance dated Oct. 18, 2018.
U.S. Appl. No. 15/700,007 Notice of Allowance dated Oct. 17, 2018.
U.S. Appl. No. 15/631,952 Office Action dated Jul. 19, 2018.
U.S. Appl. No. 15/679,857 Office Action dated Aug. 6, 2018.
U.S. Appl. No. 15/704,245 Office Action dated Sep. 17, 2018.
U.S. Appl. No. 15/842,635 Office Action dated Aug. 27, 2018.
Van Tilburg, M. Can we treat visceral hypersensitivity in functional abdominal pain? Lancet Gastroenterolhepatol, 2017; 2 Pages.

\* cited by examiner

Macrophages %.

Total lymphocytes.

Total neutrophils.

Lymphocytes %.

Bodyweights

FIG. 31 Histological Analysis – Mean Peribronchiolar Infiltration Score

FIG. 32 Histological Analysis – Mean Perivascular Infiltration Score

FIG. 33 Histological Analysis – Mean Inflammatory Score (Average of both Peribronchiolar and Perivascular Infiltration Score)

IL-9 level in lung tissue

IL-4 level in lung tissue

KC level in lung tissue

FIG. 46 HDM specific IgG1 in Serum

FIG. 51 Histological Analysis – Mean Perivascular Infiltration Score

FIG. 52 Histological Analysis - Mean Inflammatory Score (Average of both Peribronchiolar and Perivascular Infiltration Score)

TNFa level in lung tissue

IL-1a level in lung tissue

IFNg level in lung tissue

MIP-2 level in lung tissue

IL-17A level in lung tissue

MIP-1a level in lung tissue

FIG. 64
Visual Template for Histopathology Scoring
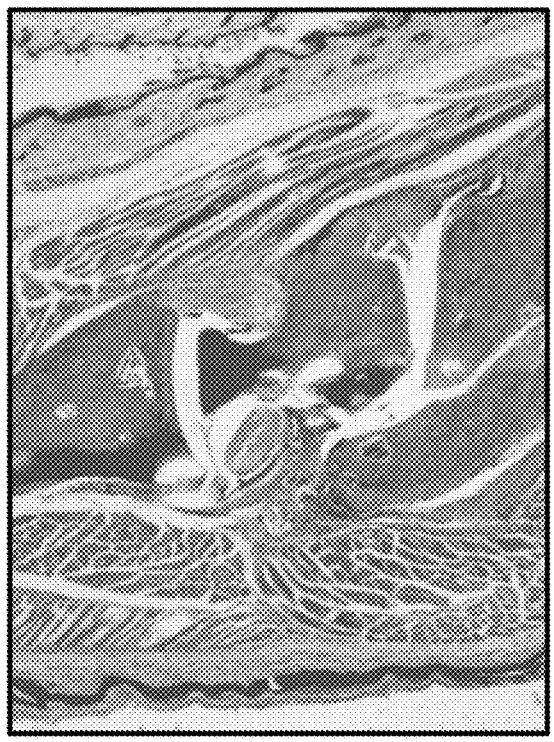
Grade 1
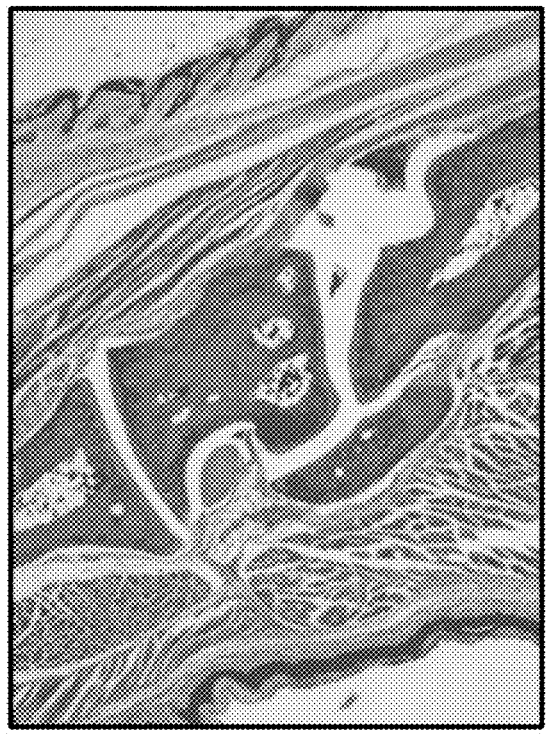
Grade 0

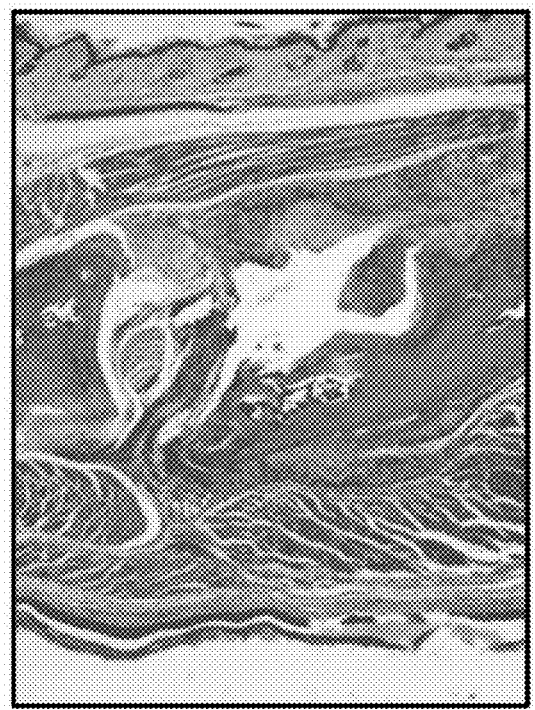
FIG. 64(contd.)
Grade 7
Grade 4

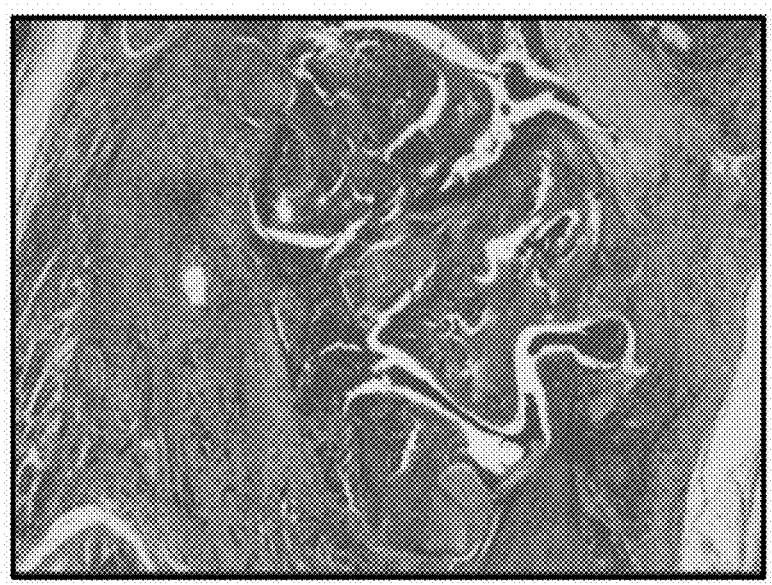
Grade 9
FIG. 64(contd.)

Histopathology: Inflammation Scores

Histopathology: Cartilage Scores

Histopathology: Bone Scores

Histopathology: Total Scores

FIG. 69
Strain #830 (#3.2R, Grade 0)
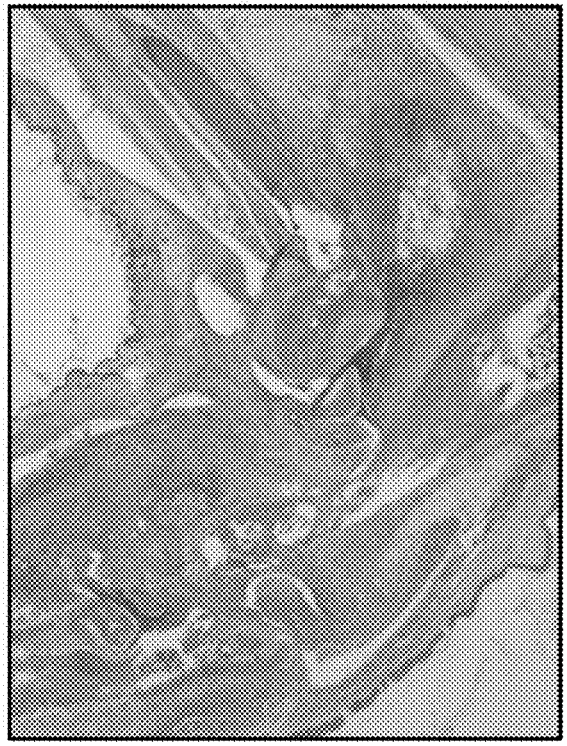
Vehicle (#1.1 1R, Grade 9)

Lymph Node Proliferative Responses to IRBP, Day 21

TEFI Scores

IL-6 Concentration

TNFa Concentration

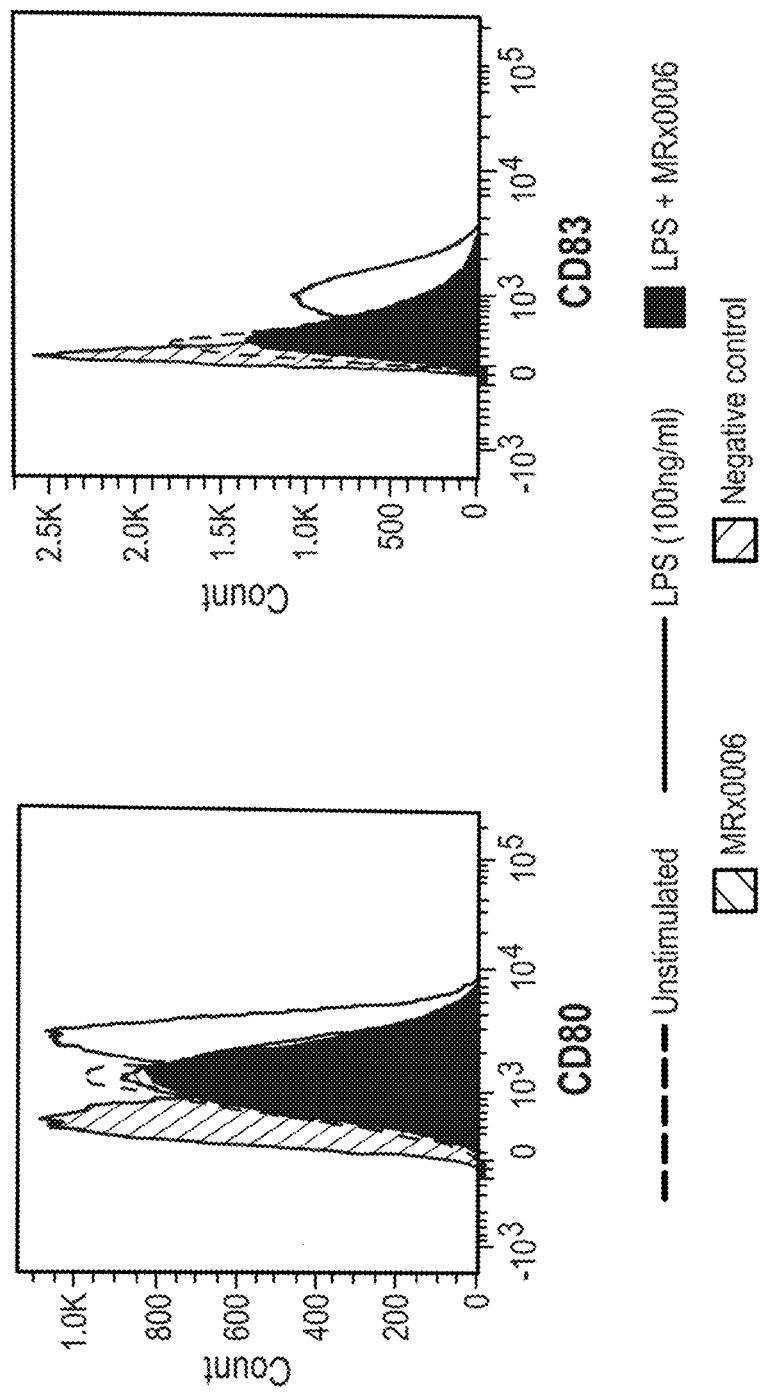

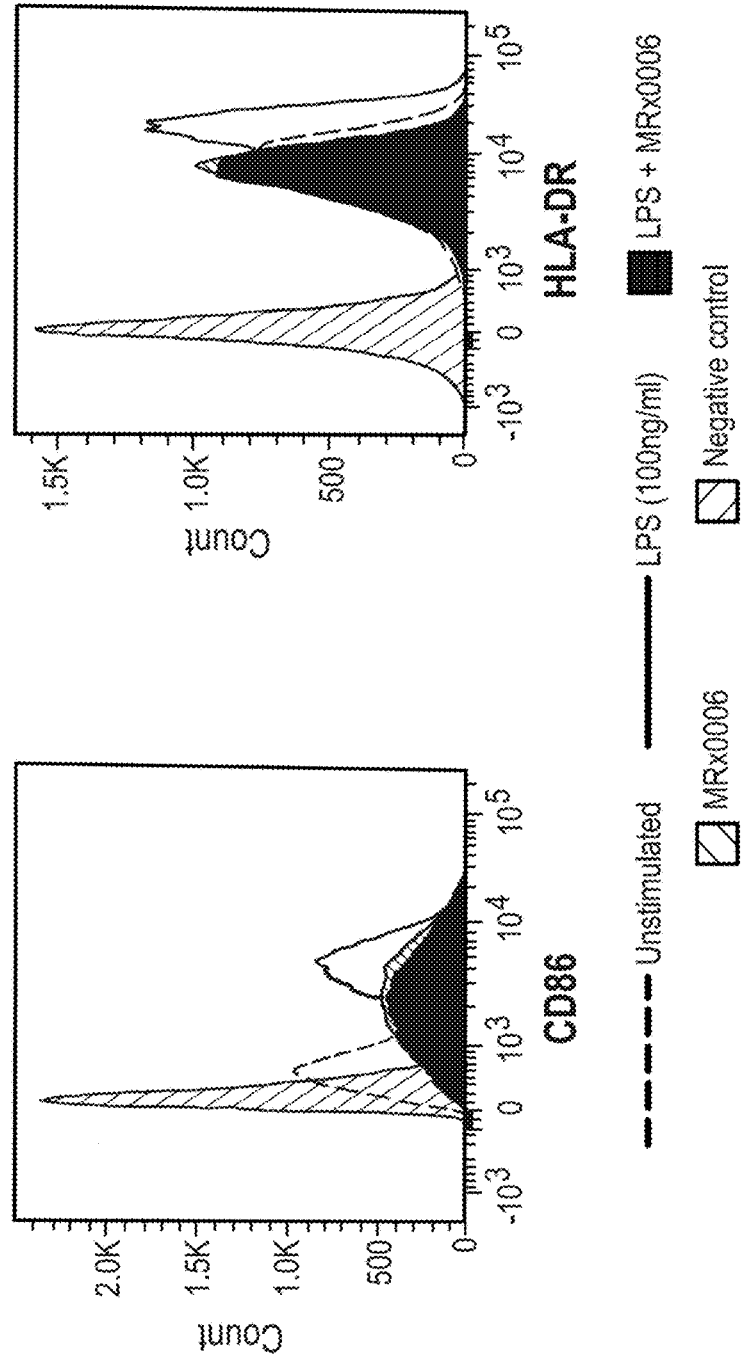
FIG. 77(contd.)
MoDC (Cd1a+ CD14-) maturation

CD4+ cell levels and divisions

COMPOSITIONS COMPRISING BACTERIAL STRAINS

CROSS-REFERENCE

This application is a continuation of International Application No. PCT/GB2016/051770, filed Jun. 15, 2016, which claims the benefit of Great Britain Application No. 1510466.4, filed Jun. 15, 2015; Great Britain Application No. 1520508.1, filed Nov. 20, 2015; Great Britain Application No. 1606810.8, filed Apr. 19, 2016, which are hereby incorporated by reference in their entirety.

SEQUENCE LISTING

The instant application contains a Sequence Listing which has been submitted electronically in ASCII format and is hereby incorporated by reference in its entirety. Said ASCII copy, created on Jun. 5, 2017, is named 49455-716 301 SL.txt and is 4,456,957 bytes in size.

TECHNICAL FIELD

This invention is in the field of compositions comprising bacterial strains isolated from the mammalian digestive tract and the use of such compositions in the treatment of disease.

BACKGROUND TO THE INVENTION

The human intestine is thought to be sterile in utero, but it is exposed to a large variety of maternal and environmental microbes immediately after birth. Thereafter, a dynamic period of microbial colonization and succession occurs, which is influenced by factors such as delivery mode, environment, diet and host genotype, all of which impact upon the composition of the gut microbiota, particularly during early life. Subsequently, the microbiota stabilizes and becomes adult-like [1]. The human gut microbiota contains more than 500-1000 different phylotypes belonging essentially to two major bacterial divisions, the Bacteroidetes and the Firmicutes [2]. The successful symbiotic relationships arising from bacterial colonization of the human gut have yielded a wide variety of metabolic, structural, protective and other beneficial functions. The enhanced metabolic activities of the colonized gut ensure that otherwise indigestible dietary components are degraded with release of by-products providing an important nutrient source for the host. Similarly, the immunological importance of the gut microbiota is well-recognized and is exemplified in germ-free animals which have an impaired immune system that is functionally reconstituted following the introduction of commensal bacteria [3-5].

Dramatic changes in microbiota composition have been documented in gastrointestinal disorders such as inflammatory bowel disease (IBD). For example, the levels of *Clostridium* cluster XIVa bacteria are reduced in IBD patients whilst numbers of *E. coli* are increased, suggesting a shift in the balance of symbionts and pathobionts within the gut [6-9]. Interestingly, this microbial dysbiosis is also associated with imbalances in T effector cell populations.

In recognition of the potential positive effect that certain bacterial strains may have on the animal gut, various strains have been proposed for use in the treatment of various diseases (see, for example, [10-13]). Also, certain strains, including mostly *Lactobacillus* and *Bifidobacterium* strains, have been proposed for use in treating various inflammatory and autoimmune diseases that are not directly linked to the intestines (see [14] and [15] for reviews). However, the relationship between different diseases and different bacterial strains, and the precise effects of particular bacterial strains on the gut and at a systemic level and on any particular types of diseases, are poorly characterised.

There is a requirement in the art for new methods of treating inflammatory and autoimmune diseases. There is also a requirement for the potential effects of gut bacteria to be characterised so that new therapies using gut bacteria can be developed.

SUMMARY OF THE INVENTION

The inventors have developed new therapies for treating and preventing inflammatory and autoimmune diseases. In particular, the inventors have developed new therapies for treating and preventing diseases and conditions mediated by IL-17 or the Th17 pathway. In particular, the inventors have identified that bacterial strains from the genus *Blautia* can be effective for reducing the Th17 inflammatory response. As described in the examples, oral administration of compositions comprising *Blautia stercoris* may reduce the severity of the inflammatory response, including the Th17 inflammatory response, in mouse models of asthma, rheumatoid arthritis and multiple sclerosis. Also, as described in the examples, oral administration of compositions comprising *Blautia wexlerae* may reduce the severity of the inflammatory response, including the Th17 inflammatory response, in mouse models of uveitis. Therefore, the inventors have identified that two different strains from different species in the genus *Blautia* may be effective for treating inflammatory and autoimmune diseases.

Therefore, in a first embodiment, the invention provides a composition comprising a bacterial strain of the genus *Blautia*, for use in a method of treating or preventing a disease or condition mediated by IL-17 or the Th17 pathway. The inventors have identified that treatment with bacterial strains from this genus can reduce levels of cytokines that are part of the Th17 pathway, including IL-17, can alleviate the Th17 inflammatory response and can provide clinical benefits in mouse models of inflammatory and autoimmune diseases mediated by IL-17 and the Th17 pathway.

In particular embodiments, the invention provides a composition comprising a bacterial strain of the genus *Blautia*, for use in a method of treating or preventing a disease or condition selected from the group consisting of: multiple sclerosis; arthritis, such as rheumatoid arthritis, osteoarthritis, psoriatic arthritis, or juvenile idiopathic arthritis; neuromyelitis optica (Devic's disease); ankylosing spondylitis; spondyloarthritis; psoriasis; systemic lupus erythematosus; inflammatory bowel disease, such as Crohn's disease or ulcerative colitis; celiac disease; asthma, such as allergic asthma or neutrophilic asthma; chronic obstructive pulmonary disease (COPD); cancer, such as breast cancer, colon cancer, lung cancer or ovarian cancer; uveitis; scleritis; vasculitis; Behcet's disease; atherosclerosis; atopic dermatitis; emphysema; periodontitis; allergic rhinitis; and allograft rejection. The effect shown for the bacterial strains from the genus *Blautia* on the Th17 inflammatory response may provide therapeutic benefits for diseases and conditions mediated by IL-17 and the Th17 pathway, such as those listed above.

In preferred embodiments, the invention provides a composition comprising a bacterial strain of the genus *Blautia*, for use in a method of treating or preventing asthma, such as neutrophilic asthma or allergic asthma. The inventors have identified that treatment with *Blautia* strains can reduce recruitment of neutrophils and eosinophils into the lungs, which can help treat or prevent asthma. Furthermore, the inventors have tested and demonstrated the efficacy of *Blautia* strains in mouse models of asthma. In certain embodiments, the composition is for use in a method of treating or preventing neutrophilic asthma or eosinophilic asthma. The effect shown for the compositions of the invention on neutrophils and eosinophils mean that they may be particularly effective for treating or preventing neutrophilic asthma and eosinophilic asthma. Indeed, in certain embodiments, the composition is for use in a method of reducing a neutrophilic inflammatory response in the treatment or prevention of asthma, or the composition is for use in a method of reducing an eosinophilic inflammatory response in the treatment or prevention of asthma. In preferred embodiments, the invention provides a composition comprising a bacterial strain of the species *Blautia stercoris* for use in the treatment of asthma, and in particular eosinophilic or allergic asthma. Also, *Blautia stercoris* is shown to have a particularly pronounced effect on neutrophils in asthma models and treatment with *Blautia stercoris* may be particularly effective for treating neutrophilic asthma. In certain embodiments, the invention provides a composition comprising a bacterial strain of the species *Blautia wexlerae* for use in the treatment of asthma, and in particular eosinophilic or allergic asthma.

In further preferred embodiments, the invention provides a composition comprising a bacterial strain of the genus *Blautia*, for use in a method of treating or preventing rheumatoid arthritis. The inventors have identified that treatment with *Blautia* strains can provide clinical benefits in a mouse model of rheumatoid arthritis and can reduce joint swelling. In preferred embodiments, the invention provides a composition comprising a bacterial strain of the species *Blautia stercoris*, for use in the treatment of rheumatoid arthritis. Compositions using *Blautia stercoris* may be particularly effective for treating rheumatoid arthritis. In certain embodiments, the invention provides a composition comprising a bacterial strain of the species *Blautia wexlerae*, for use in the treatment of rheumatoid arthritis.

In further preferred embodiments, the invention provides a composition comprising a bacterial strain of the genus *Blautia*, for use in a method of treating or preventing multiple sclerosis. The inventors have identified that treatment with *Blautia* strains can reduce disease incidence and disease severity in a mouse model of multiple sclerosis. In preferred embodiments, the invention provides a composition comprising a bacterial strain of the species *Blautia stercoris*, for use in the treatment of multiple sclerosis. Compositions using *Blautia stercoris* may be particularly effective for treating multiple sclerosis. In certain embodiments, the invention provides a composition comprising a bacterial strain of the species *Blautia wexlerae*, for use in the treatment of multiple sclerosis.

In further preferred embodiments, the invention provides a composition comprising a bacterial strain of the genus *Blautia*, for use in a method of treating or preventing uveitis, such as posterior uveitis. The inventors have identified that treatment with *Blautia* strains can reduce disease incidence and disease severity in a mouse model of uveitis and can prevent or reduce retinal damage. In preferred embodiments, the invention provides a composition comprising a bacterial strain of the species *Blautia wexlerae*, for use in the treatment of uveitis. Compositions using *Blautia wexlerae* may be particularly effective for treating uveitis. In certain embodiments, the invention provides a composition comprising a bacterial strain of the species *Blautia stercoris*, for use in the treatment of uveitis.

In further preferred embodiments, the invention provides a composition comprising a bacterial strain of the genus *Blautia*, for use in a method of treating or preventing cancer, such as breast, lung or liver cancer. Compositions comprising a bacterial strain of the genus *Blautia* may reduce tumour growth in mouse models of breast, lung and liver cancer. In certain embodiments, the composition is for use in a method of reducing tumour size or preventing tumour growth in the treatment of cancer. In certain embodiments, the invention provides a composition comprising a bacterial strain of the species *Blautia stercoris*, for use in the treatment of cancer. In certain embodiments, the invention provides a composition comprising a bacterial strain of the species *Blautia wexlerae*, for use in the treatment of cancer.

In certain embodiments, the compositions of the invention are for use in a method of reducing IL-17 production or reducing Th17 cell differentiation in the treatment or prevention of a disease or condition mediated by IL-17 or the Th17 pathway. In particular, the compositions of the invention may be used in reducing IL-17 production or reducing Th17 cell differentiation in the treatment or prevention of asthma, rheumatoid arthritis or multiple sclerosis, or of asthma, rheumatoid arthritis, multiple sclerosis, uveitis or cancer. Preferably, the invention provides compositions comprising a bacterial strain of the species *Blautia stercoris*, for use in reducing IL-17 production or reducing Th17 cell differentiation in the treatment or prevention of asthma, rheumatoid arthritis or multiple sclerosis. The invention also provides compositions comprising a bacterial strain of the species *Blautia stercoris*, for use in reducing IL-17 production or reducing Th17 cell differentiation in the treatment or prevention of uveitis. The invention also provides compositions comprising a bacterial strain of the species *Blautia wexlerae*, for use in reducing IL-17 production or reducing Th17 cell differentiation in the treatment or prevention of asthma, rheumatoid arthritis or multiple sclerosis or uveitis.

In certain embodiments, the composition is for use in a patient with elevated IL-17 levels or Th17 cells. The effect on the Th17 inflammatory response shown for *Blautia* strains may be particularly beneficial for such patients.

In preferred embodiments of the invention, the bacterial strain in the composition is of *Blautia stercoris*. Closely related strains may also be used, such as bacterial strains that have a 16s rRNA sequence that is at least 95%, 96%, 97%, 98%, 99%, 99.5% or 99.9% identical to the 16s rRNA sequence of a bacterial strain of *Blautia stercoris*. Preferably, the bacterial strain has a 16s rRNA sequence that is at least 95%, 96%, 97%, 98%, 99%, 99.5% or 99.9% identical to SEQ ID NO:1 or 2. Preferably, the sequence identity is to SEQ ID NO:2. Preferably, the bacterial strain for use in the invention has the 16s rRNA sequence represented by SEQ ID NO:2.

In preferred embodiments of the invention, the bacterial strain in the composition is of *Blautia wexlerae*. Closely related strains may also be used, such as bacterial strains that have a 16s rRNA sequence that is at least 95%, 96%, 97%, 98%, 99%, 99.5% or 99.9% identical to the 16s rRNA sequence of a bacterial strain of *Blautia wexlerae*. Preferably, the bacterial strain has a 16s rRNA sequence that is at least 95%, 96%, 97%, 98%, 99%, 99.5% or 99.9% identical to SEQ ID NO:3 or 4. Preferably, the sequence identity is to SEQ ID NO:4. Preferably, the bacterial strain for use in the invention has the 16s rRNA sequence represented by SEQ ID NO:4.

In certain embodiments, the composition of the invention is for oral administration. Oral administration of the strains of the invention can be effective for treating IL-17- or Th17 pathway-mediated diseases and conditions. Also, oral administration is convenient for patients and practitioners and allows delivery to and/or partial or total colonisation of the intestine.

In certain embodiments, the composition of the invention comprises one or more pharmaceutically acceptable excipients or carriers.

In certain embodiments, the composition of the invention comprises a bacterial strain that has been lyophilised. Lyophilisation is an effective and convenient technique for preparing stable compositions that allow delivery of bacteria.

In certain embodiments, the invention provides a food product comprising the composition as described above.

In certain embodiments, the invention provides a vaccine composition comprising the composition as described above.

Additionally, the invention provides a method of treating or preventing a disease or condition mediated by IL-17 or the Th17 pathway, comprising administering a composition comprising a bacterial strain of the genus *Blautia*.

In developing the above invention, the inventors have identified and characterised a bacterial strain that is particularly useful for therapy. The *Blautia stercoris* strain of the invention is shown to be effective for treating the diseases described herein, such as arthritis, asthma and multiple sclerosis. Therefore, in another aspect, the invention provides a cell of the *Blautia stercoris* strain deposited under accession number NCIMB 42381, or a derivative thereof. The invention also provides compositions comprising such cells, or biologically pure cultures of such cells. The invention also provides a cell of the *Blautia stercoris* strain deposited under accession number NCIMB 42381, or a derivative thereof, for use in therapy, in particular for the diseases described herein.

In developing the above invention, the inventors have identified and characterised a further bacterial strain that is particularly useful for therapy. The *Blautia wexlerae* strain of the invention is shown to be effective for treating the diseases described herein, such as uveitis. Therefore, in another aspect, the invention provides a cell of the *Blautia wexlerae* strain deposited under accession number NCIMB 42486, or a derivative thereof. The invention also provides compositions comprising such cells, or biologically pure cultures of such cells. The invention also provides a cell of the *Blautia wexlerae* strain deposited under accession number NCIMB 42486, or a derivative thereof, for use in therapy, in particular for the diseases described herein.

BRIEF DESCRIPTION OF DRAWINGS

FIG. 64: Mouse model of rheumatoid arthritis—Visual Template for Histopathology Scoring. Representative images showing composite scores from mouse tarsal joints in a collagen-induced arthritis study.

FIG. 69: Mouse model of rheumatoid arthritis—Histopathology: Representative Pictures. Animal ID (#n.n) and limb (R for right, L for left) are indicated between brackets. Left image (vehicle): extensive joint and bone destruction with inflammation and fibrosis extending to the peri-articular soft tissues.

FIG. 77: LPS-induced inflammatory assay—level of Mo-DC maturation

DISCLOSURE OF THE INVENTION

Bacterial Strains

Figure 1:
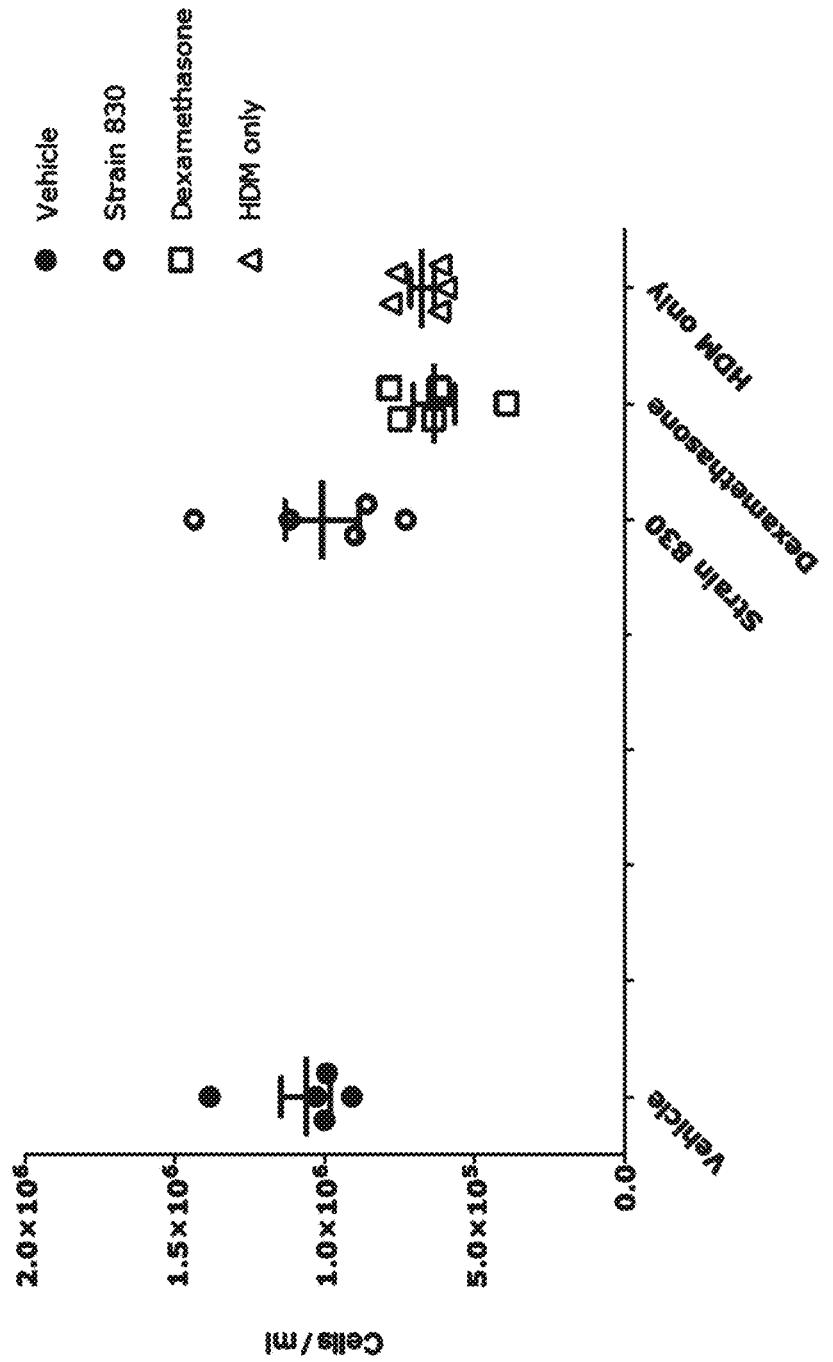
FIG. 1: Mouse model of house dust mite-induced asthma—Total BAL fluid cell counts.
Figure 2:
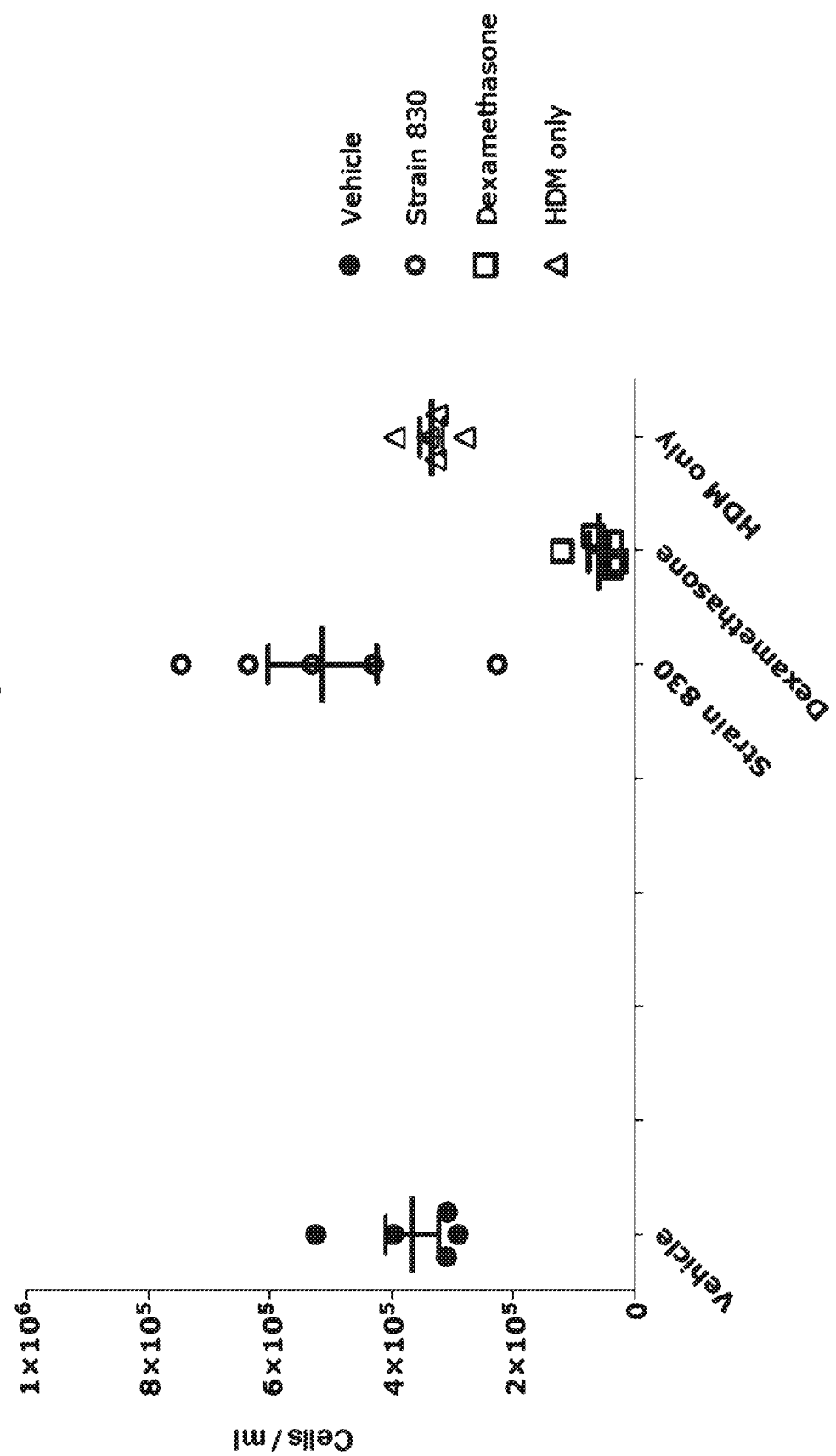
FIG. 2: Mouse model of house dust mite-induced asthma—Total eosinophil count in BALF.
Figure 3:
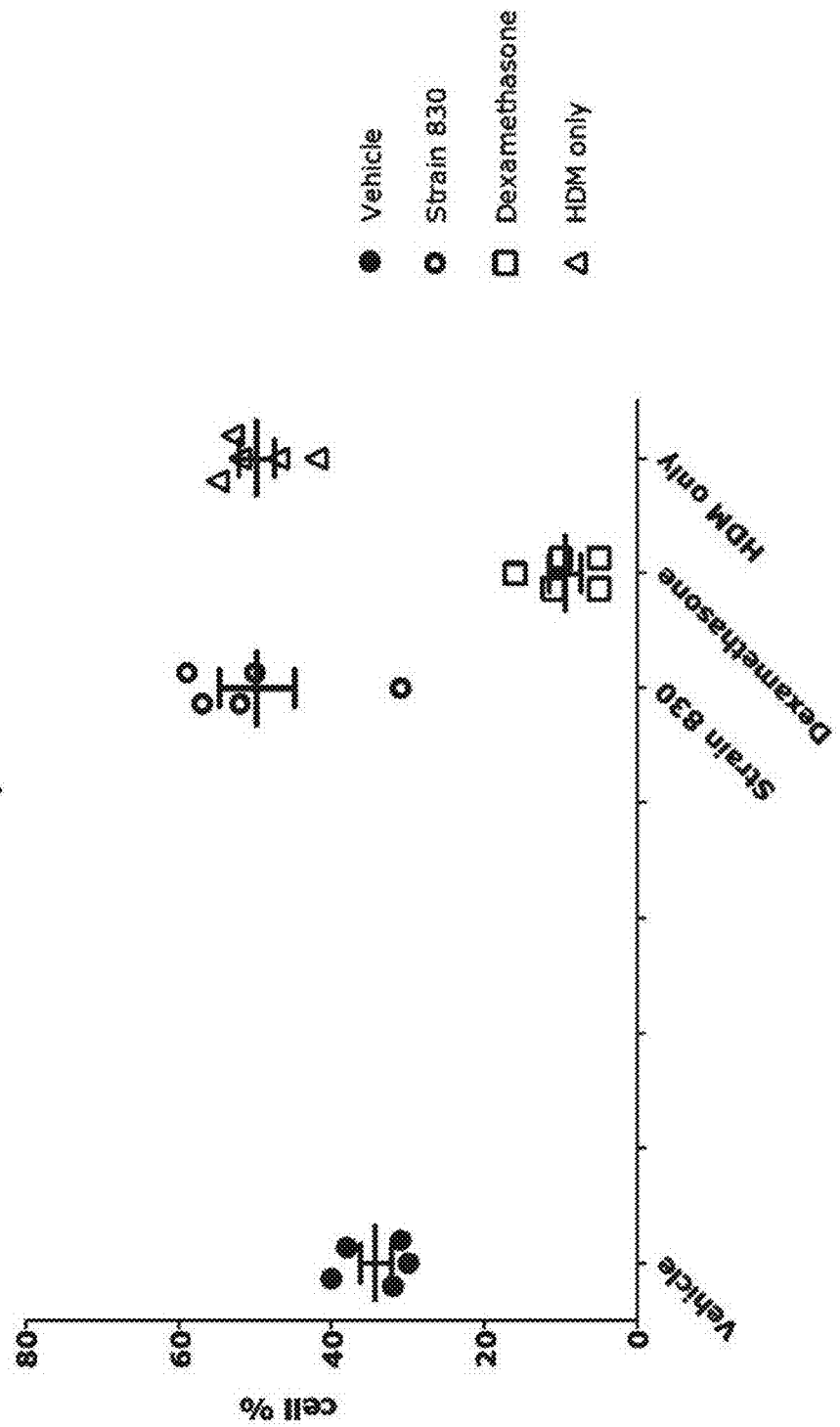
FIG. 3: Mouse model of house dust mite-induced asthma—Proportion of eosinophils in BALF.
Figure 4:
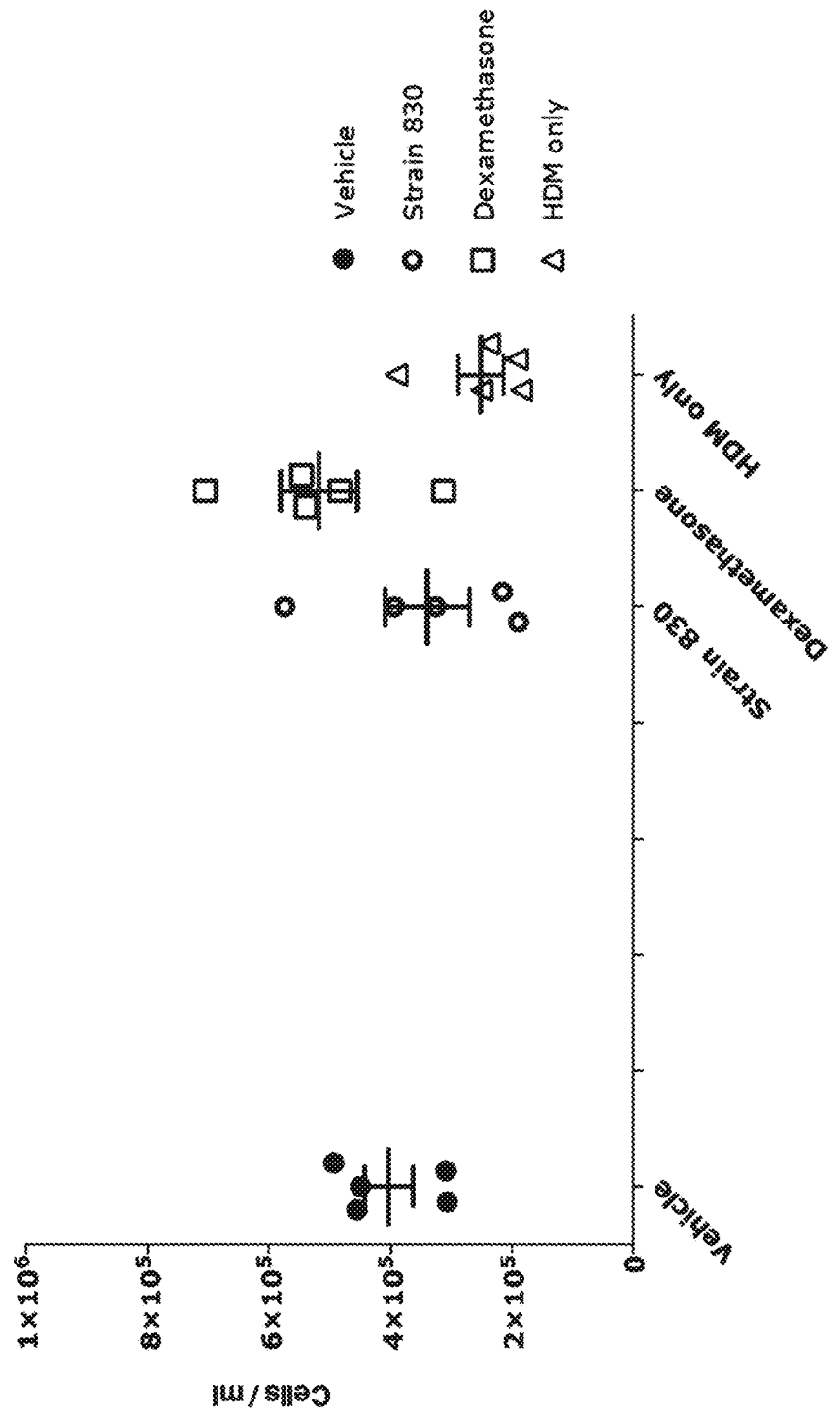
FIG. 4: Mouse model of house dust mite-induced asthma—Total macrophage count in BALF.
Figure 5:
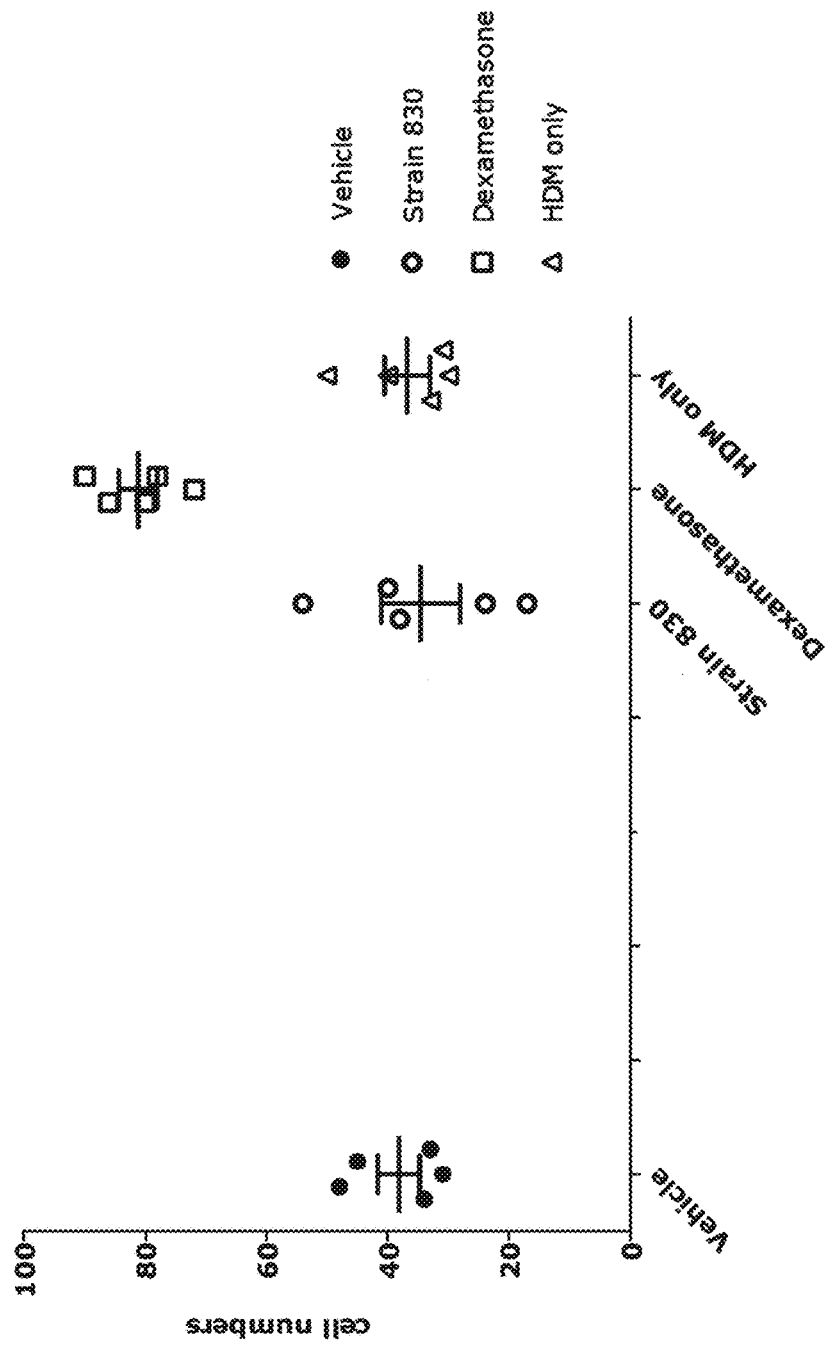
FIG. 5: Mouse model of house dust mite-induced asthma—Proportion of macrophages in BALF.

The compositions of the invention comprise a bacterial strain of the genus *Blautia*. The examples demonstrate that bacteria of this genus are useful for treating or preventing diseases and conditions mediated by IL-17 or the Th17 pathway. The preferred bacterial strains are of the species *Blautia*.

Examples of *Blautia* strains for use in the invention include *Blautia stercoris*, *B. faecis*, *B. coccoides*, *B. glucerasea*, *B. hansenii*, *B. hydrogenotrophica*, *B. luti*, *B. producta*, *B. schinkii* and *B. wexlerae*.

The *Blautia* species are Gram-reaction-positive, non-motile bacteria that may be either coccoid or oval and all are obligate anaerobes that produce acetic acid as the major end product of glucose fermentation [16]. *Blautia* may be isolated from the human gut, although *B. producta* was isolated from a *septicaemia* sample. The GenBank accession number for the 16S rRNA gene sequence of *Blautia stercoris* strain GAM6-1$^T$ is HM626177 (disclosed herein as SEQ ID NO:1). An exemplary *Blautia stercoris* strain is described in [17]. The type strain of *Blautia wexlerae* is WAL 14507=ATCC BAA-1564=DSM 19850 [18]. The GenBank accession number for the 16S rRNA gene sequence of *Blautia wexlerae* strain WAL 14507 T is EF036467 (disclosed herein as SEQ ID NO:3). This exemplary *Blautia wexlerae* strain is described in [18].

The *Blautia stercoris* bacterium deposited under accession number NCIMB 42381 was tested in the Examples and is also referred to herein as strain 830. A 16S rRNA sequence for the 830 strain that was tested is provided in SEQ ID NO:2. Strain 830 was deposited with the international depositary authority NCIMB, Ltd. (Ferguson Building, Aberdeen, AB21 9YA, Scotland) by GT Biologics Ltd. (Life Sciences Innovation Building, Aberdeen, AB25 2ZS, Scotland) on 12 Mar. 2015 as "*Blautia stercoris* 830" and was assigned accession number NCIMB 42381. GT Biologics Ltd. subsequently changed its name to 4D Pharma Research Limited.

The genome of strain 830 comprises a chromosome and plasmid. A chromosome sequence for strain 830 is provided in SEQ ID NO:5. A plasmid sequence for strain 830 is provided in SEQ ID NO:6. These sequences were generated using the PacBio RS II platform.

The *Blautia wexlerae* bacterium deposited under accession number NCIMB 42486 was tested in the Examples and is also referred to herein as strain MRX008. A 16S rRNA sequence for the MRX008 strain that was tested is provided in SEQ ID NO:4. Strain MRX008 was deposited with the international depositary authority NCIMB, Ltd. (Ferguson Building, Aberdeen, AB21 9YA, Scotland) by 4D Pharma Research Ltd. (Life Sciences Innovation Building, Aberdeen, AB25 2ZS, Scotland) on 16 Nov. 2015 as "*Blautia/Ruminococcus*" and was assigned accession number NCIMB 42486.

The NCIMB 42381 and NCIMB 42382 deposits were made under the terms of the Budapest Treaty. Maintenance of a viable culture is assured for 30 years from the date of the deposits. All restrictions on the availability to the public of the deposited microorganisms will be irrevocably removed upon the granting of a patent for this application.

Bacterial strains closely related to the strains tested in the examples are also expected to be effective for treating or preventing diseases and conditions mediated by IL-17 or the Th17 pathway. In certain embodiments, the bacterial strain for use in the invention has a 16s rRNA sequence that is at least 95%, 96%, 97%, 98%, 99%, 99.5% or 99.9% identical to the 16s rRNA sequence of a bacterial strain of *Blautia stercoris*. Preferably, the bacterial strain for use in the invention has a 16s rRNA sequence that is at least 95%, 96%, 97%, 98%, 99%, 99.5% or 99.9% identical to SEQ ID NO:1 or 2. Preferably, the sequence identity is to SEQ ID NO:2. Preferably, the bacterial strain for use in the invention has the 16s rRNA sequence represented by SEQ ID NO:2. In certain embodiments, the bacterial strain for use in the invention has a 16s rRNA sequence that is at least 95%, 96%, 97%, 98%, 99%, 99.5% or 99.9% identical to the 16s rRNA sequence of a bacterial strain of *Blautia wexlerae*. Preferably, the bacterial strain for use in the invention has a 16s rRNA sequence that is at least 95%, 96%, 97%, 98%, 99%, 99.5% or 99.9% identical to SEQ ID NO:3 or 4. Preferably, the sequence identity is to SEQ ID NO:4. Preferably, the bacterial strain for use in the invention has the 16s rRNA sequence represented by SEQ ID NO:4.

In certain embodiments, the bacterial strain for use in the invention has a chromosome with sequence identity to SEQ ID NO:5. In preferred embodiments, the bacterial strain for use in the invention has a chromosome with at least 90% sequence identity (e.g. at least 92%, 94%, 95%, 96%, 97%, 98%, 99% or 100% sequence identity) to SEQ ID NO:5 across at least 60% (e.g. at least 65%, 70%, 75%, 80%, 85%, 95%, 96%, 97%, 98%, 99% or 100%) of SEQ ID NO:5. For example, the bacterial strain for use in the invention may have a chromosome with at least 90% sequence identity to SEQ ID NO: 5 across 70% of SEQ ID NO:5, or at least 90% sequence identity to SEQ ID NO:5 across 80% of SEQ ID NO:5, or at least 90% sequence identity to SEQ ID NO:5 across 90% of SEQ ID NO:5, or at least 90% sequence identity to SEQ ID NO:5 across 100% of SEQ ID NO:5, or at least 95% sequence identity to SEQ ID NO:5 across 70% of SEQ ID NO:5, or at least 95% sequence identity to SEQ ID NO:5 across 80% of SEQ ID NO:5, or at least 95% sequence identity to SEQ ID NO:5 across 90% of SEQ ID NO:5, or at least 95% sequence identity to SEQ ID NO:5 across 100% of SEQ ID NO:5, or at least 98% sequence identity to SEQ ID NO:5 across 70% of SEQ ID NO:5, or at least 98% sequence identity to SEQ ID NO:5 across 80% of SEQ ID NO:5, or at least 98% sequence identity to SEQ ID NO:5 across 90% of SEQ ID NO:5, or at least 98% sequence identity to SEQ ID NO:5 across 100% of SEQ ID NO:5.

In certain embodiments, the bacterial strain for use in the invention has a plasmid with sequence identity to SEQ ID NO:6. In preferred embodiments, the bacterial strain for use in the invention has a plasmid with at least 90% sequence identity (e.g. at least 92%, 94%, 95%, 96%, 97%, 98%, 99% or 100% sequence identity) to SEQ ID NO:6 across at least 60% (e.g. at least 65%, 70%, 75%, 80%, 85%, 95%, 96%, 97%, 98%, 99% or 100%) of SEQ ID NO:6. For example, the bacterial strain for use in the invention may have a plasmid with at least 90% sequence identity to SEQ ID NO:6 across 70% of SEQ ID NO:6, or at least 90% sequence identity to SEQ ID NO:6 across 80% of SEQ ID NO:6, or at least 90% sequence identity to SEQ ID NO:6 across 90% of SEQ ID NO:6, or at least 90% sequence identity to SEQ ID NO:6 across 100% of SEQ ID NO:6, or at least 95% sequence identity to SEQ ID NO:6 across 70% of SEQ ID NO:6, or at least 95% sequence identity to SEQ ID NO:6 across 80% of SEQ ID NO:6, or at least 95% sequence identity to SEQ ID NO:6 across 90% of SEQ ID NO:6, or at least 95% sequence identity to SEQ ID NO:6 across 100% of SEQ ID NO:6, or at least 98% sequence identity to SEQ ID NO:6 across 70% of SEQ ID NO:6, or at least 98% sequence identity to SEQ ID NO:6 across 80% of SEQ ID NO:6, or at least 98% sequence identity to SEQ ID NO:6 across 90% of SEQ ID NO:6, or at least 98% sequence identity to SEQ ID NO:6 across 100% of SEQ ID NO:6.

In certain embodiments, the bacterial strain for use in the invention has a chromosome with sequence identity to SEQ ID NO:5 and a plasmid with sequence identity to SEQ ID NO:6.

Bacterial strains that are biotypes of the bacterium deposited under accession number 42381 are also expected to be effective for treating or preventing diseases and conditions mediated by IL-17 or the Th17 pathway. Bacterial strains that are biotypes of the bacterium deposited under accession number 42486 are also expected to be effective for treating or preventing diseases and conditions mediated by IL-17 or the Th17 pathway. A biotype is a closely related strain that has the same or very similar physiological and biochemical characteristics.

Strains that are biotypes of a bacterium deposited under accession number NCIMB 42381 or 42486 and that are suitable for use in the invention may be identified by sequencing other nucleotide sequences for a bacterium deposited under accession number NCIMB 42381 or 42486. For example, substantially the whole genome may be sequenced and a biotype strain for use in the invention may have at least 95%, 96%, 97%, 98%, 99%, 99.5% or 99.9% sequence identity across at least 80% of its whole genome (e.g. across at least 85%, 90%, 95% or 99%, or across its whole genome). Other suitable sequences for use in identifying biotype strains may include hsp60 or repetitive sequences such as BOX, ERIC, (GTG)$_5$, or REP or [19]. Biotype strains may have sequences with at least 95%, 96%, 97%, 98%, 99%, 99.5% or 99.9% sequence identity to the corresponding sequence of a bacterium deposited under accession number NCIMB 42381 or 42486.

Alternatively, strains that are biotypes of a bacterium deposited under accession number NCIMB 42381 or 42486 and that are suitable for use in the invention may be identified by using the accession number NCIMB 42381 deposit or the accession number NCIMB 42486 deposit, and restriction fragment analysis and/or PCR analysis, for example by using fluorescent amplified fragment length polymorphism (FAFLP) and repetitive DNA element (rep)-PCR fingerprinting, or protein profiling, or partial 16S or 23s rDNA sequencing. In preferred embodiments, such techniques may be used to identify other *Blautia stercoris* or *Blautia wexlerae* strains.

In certain embodiments, strains that are biotypes of a bacterium deposited under accession number NCIMB 42381 or 42486 and that are suitable for use in the invention are strains that provide the same pattern as a bacterium deposited under accession number NCIMB 42381 or 42486 when analysed by amplified ribosomal DNA restriction analysis (ARDRA), for example when using Sau3AI restriction enzyme (for exemplary methods and guidance see, for example, [20]). Alternatively, biotype strains are identified as strains that have the same carbohydrate fermentation patterns as a bacterium deposited under accession number NCIMB 42381 or 42486.

Other *Blautia* strains that are useful in the compositions and methods of the invention, such as biotypes of a bacterium deposited under accession number NCIMB 42381 or 42486, may be identified using any appropriate method or strategy, including the assays described in the examples. For instance, strains for use in the invention may be identified by culturing in anaerobic YCFA and/or administering the bacteria to the type II collagen-induced arthritis mouse model and then assessing cytokine levels. In particular, bacterial strains that have similar growth patterns, metabolic type and/or surface antigens to a bacterium deposited under accession number NCIMB 42381 or 42486 may be useful in the invention. A useful strain will have comparable immune modulatory activity to the NCIMB 42381 or 42486 strain. In particular, a biotype strain will elicit comparable effects on the asthma, arthritis, multiple sclerosis and uveitis disease models and comparable effects on cytokine levels to the effects shown in the Examples, which may be identified by using the culturing and administration protocols described in the Examples.

A particularly preferred strain of the invention is the *Blautia stercoris* strain deposited under accession number NCIMB 42381. This is the exemplary 830 strain tested in the examples and shown to be effective for treating disease. Therefore, the invention provides a cell, such as an isolated cell, of the *Blautia stercoris* strain deposited under accession number NCIMB 42381, or a derivative thereof. The invention also provides a composition comprising a cell of the *Blautia stercoris* strain deposited under accession number NCIMB 42381, or a derivative thereof. The invention also provides a biologically pure culture of the *Blautia stercoris* strain deposited under accession number NCIMB 42381. The invention also provides a cell of the *Blautia stercoris* strain deposited under accession number NCIMB 42381, or a derivative thereof, for use in therapy, in particular for the diseases described herein.

A particularly preferred strain of the invention is the *Blautia wexlerae* strain deposited under accession number NCIMB 42486. This is the exemplary MRX008 strain tested in the examples and shown to be effective for treating disease. Therefore, the invention provides a cell, such as an isolated cell, of the *Blautia wexlerae* strain deposited under accession number NCIMB 42486, or a derivative thereof. The invention also provides a composition comprising a cell of the *Blautia wexlerae* strain deposited under accession number NCIMB 42486, or a derivative thereof. The invention also provides a biologically pure culture of the *Blautia wexlerae* strain deposited under accession number NCIMB 42486. The invention also provides a cell of the *Blautia wexlerae* strain deposited under accession number NCIMB 42486, or a derivative thereof, for use in therapy, in particular for the diseases described herein.

A derivative of the strain deposited under accession number NCIMB 42381 or 42486 may be a daughter strain (progeny) or a strain cultured (subcloned) from the original. A derivative of a strain of the invention may be modified, for example at the genetic level, without ablating the biological activity. In particular, a derivative strain of the invention is therapeutically active. A derivative strain will have comparable immune modulatory activity to the original NCIMB 42381 or 42486 strain. In particular, a derivative strain will elicit comparable effects on the asthma, arthritis, multiple sclerosis and uveitis disease models and comparable effects on cytokine levels to the effects shown in the Examples, which may be identified by using the culturing and administration protocols described in the Examples. A derivative of the NCIMB 42381 strain will generally be a biotype of the NCIMB 42381 strain. A derivative of the NCIMB 42486 strain will generally be a biotype of the NCIMB 42486 strain.

References to cells of the *Blautia stercoris* strain deposited under accession number NCIMB 42381 encompass any cells that have the same safety and therapeutic efficacy characteristics as the strains deposited under accession number NCIMB 42381, and such cells are encompassed by the invention. References to cells of the *Blautia wexlerae* strain deposited under accession number NCIMB 42486 encompass any cells that have the same safety and therapeutic efficacy characteristics as the strains deposited under accession number NCIMB 42486, and such cells are encompassed by the invention.

In preferred embodiments, the bacterial strains in the compositions of the invention are viable and capable of partially or totally colonising the intestine.

Therapeutic Uses

As demonstrated in the examples, the bacterial compositions of the invention are effective for reducing the Th17 inflammatory response. In particular, treatment with compositions of the invention achieves a reduction in IL-17A levels and other Th17 pathway cytokines, and clinical improvements in animal models of conditions mediated by IL-17 and the Th17 pathway. Therefore, the compositions of the invention may be useful for treating or preventing inflammatory and autoimmune diseases, and in particular diseases or conditions mediated by IL-17. In particular, the compositions of the invention may be useful for reducing or preventing elevation of the IL-17 inflammatory response.

Th17 cells are a subset of T helper cells that produce, for example, IL-17A, IL17-F, IL-21 and IL-22. Th17 cell differentiation and IL-17 expression may be driven by IL-23. These cytokines and others form important parts of the Th17 pathway, which is a well-established inflammatory signalling pathway that contributes to and underlies a number of inflammatory and autoimmune diseases (as described in, for example, [21-26]). Diseases wherein the Th17 pathway is activated are Th17 pathway-mediated diseases. Th17 pathway-mediated diseases can be ameliorated or alleviated by repressing the Th17 pathway, which may be through a reduction in the differentiation of Th17 cells or a reduction in their activity or a reduction in the level of Th17 pathway cytokines. Diseases mediated by the Th17 pathway may be characterised by increased levels of cytokines produced by Th17 cells, such as IL-17A, IL-17F, IL-21, IL-22, IL-26, IL-9 (reviewed in [27]). Diseases mediated by the Th17 pathway may be characterised by increased expression of Th-17-related genes, such as Stat3 or IL-23R. Diseases mediated by the Th17 pathway may be associated with increased levels of Th17 cells.

IL-17 is a pro-inflammatory cytokine that contributes to the pathogenesis of several inflammatory and autoimmune diseases and conditions. IL-17 as used herein may refer to any member of the IL-17 family, including IL-17A, IL-17B, IL-17C, IL-17D, IL-17E, and IL-17F. IL-17-mediated diseases and conditions are characterised by high expression of IL-17 and/or the accumulation or presence of IL-17-positive cells in a tissue affected by the disease or condition. Similarly, IL-17-mediated diseases and conditions are diseases and conditions that are exacerbated by high IL-17 levels or an increase in IL-17 levels, and that are alleviated by low IL-17 levels or a reduction in IL-17 levels. The IL-17 inflammatory response may be local or systemic.

Examples of diseases and conditions that may be mediated by IL-17 or the Th17 pathway include multiple sclerosis; arthritis, such as rheumatoid arthritis, osteoarthritis, psoriatic arthritis, or juvenile idiopathic arthritis; neuromyelitis optica (Devic's disease); ankylosing spondylitis; spondyloarthritis; psoriasis; systemic lupus erythematosus; inflammatory bowel disease, such as Crohn's disease or ulcerative colitis; celiac disease; asthma, such as allergic asthma or neutrophilic asthma; chronic obstructive pulmonary disease (COPD); cancer, such as breast cancer, colon cancer, lung cancer or ovarian cancer; uveitis; scleritis; vasculitis; Behcet's disease; atherosclerosis; atopic dermatitis; emphysema; periodontitis; allergic rhinitis; and allograft rejection. In preferred embodiments, the compositions of the invention are used for treating or preventing one or more of these conditions or diseases. In further preferred embodiments, these conditions or diseases are mediated by IL-17 or the Th17 pathway.

In certain embodiments, the compositions of the invention are for use in a method of reducing IL-17 production or reducing Th17 cell differentiation in the treatment or prevention of a disease or condition mediated by IL-17 or the Th17 pathway. In certain embodiments, the compositions of the invention are for use in treating or preventing an inflammatory or autoimmune disease, wherein said treatment or prevention is achieved by reducing or preventing elevation of the Th17 inflammatory response. In certain embodiments, the compositions of the invention are for use in treating a patient with an inflammatory or autoimmune disease, wherein the patient has elevated IL-17 levels or elevated Th17 cells or is exhibiting a Th17 inflammatory response. In certain embodiments, the patient may have been diagnosed with a chronic inflammatory or autoimmune disease or condition, or the composition of the invention may be for use in preventing an inflammatory or autoimmune disease or condition developing into a chronic inflammatory or autoimmune disease or condition. In certain embodiments, the disease or condition may not be responsive to treatment with TNF-α inhibitors. These uses of the invention may be applied to any of the specific disease or conditions listed in the preceding paragraph.

IL-17 and the Th17 pathway are often associated with chronic inflammatory and autoimmune diseases, so the compositions of the invention may be particularly useful for treating or preventing chronic diseases or conditions as listed above. In certain embodiments, the compositions are for use in patients with chronic disease. In certain embodiments, the compositions are for use in preventing the development of chronic disease.

The compositions of the invention may be useful for treating diseases and conditions mediated by IL-17 or the Th17 pathway and for addressing the Th17 inflammatory response, so the compositions of the invention may be particularly useful for treating or preventing chronic disease, treating or preventing disease in patients that have not responded to other therapies (such as treatment with TNF-α inhibitors), and/or treating or preventing the tissue damage and symptoms associated with IL-17 and Th17 cells. For example, IL-17 is known to activate matrix destruction in cartilage and bone tissue and IL-17 has an inhibitory effect on matrix production in chondrocytes and osteoblasts, so the compositions of the invention may be useful for treating or preventing bone erosion or cartilage damage.

In certain embodiments, treatment with compositions of the invention provides a reduction or prevents an elevation in IL-17 levels, in particular IL-17A levels. In certain embodiments, treatment with compositions of the invention provides a reduction or prevents an elevation in TNFα, IFN-γ or IL-6 levels. Such reduction or prevention of elevated levels of these cytokines may be useful for treating or preventing inflammatory and autoimmune diseases and conditions, in particular those mediated by IL-17 or the Th17 pathway.

In certain embodiments, treatment with compositions of the invention provides a reduction or prevents an elevation in CD4+ cell levels. In certain embodiments, treatment with compositions of the invention provides a reduction or prevents an elevation in the level of dendritic cell maturation, in particular of CD1a+CD14− monocyte derived dendritic cells. Such a reduction or prevention of elevated levels of the CD4+ cell levels or the reduction or prevention of elevation in the level of dendritic cell maturation may be useful for treating or preventing inflammatory and autoimmune diseases and conditions, in particular those mediated by IL-17 or the Th17 pathway.

Asthma

In preferred embodiments, the compositions of the invention are for use in treating or preventing asthma. The examples demonstrate that the compositions of the invention achieve a reduction in the recruitment of neutrophils and/or eosinophils into the airways following sensitisation and challenge with house dust mite extract and so they may be useful in the treatment or prevention of asthma. Asthma is a chronic disease characterised by inflammation and restriction of the airways. The inflammation in asthma may be mediated by IL-17 and/or Th17 cells, and so the compositions of the invention may be particularly effective for preventing or treating asthma. The inflammation in asthma may be mediated by eosinophils and/or neutrophils.

In certain embodiments, the asthma is eosinophilic or allergic asthma. Eosinophilic and allergic asthma are characterised by increased numbers of eosinophils in peripheral blood and in airway secretions and is associated pathologically with thickening of the basement membrane zone and pharmacologically by corticosteroid responsiveness [28]. Compositions that reduce or inhibit eosinophil recruitment or activation may be useful for treating or preventing eosinophilic and allergic asthma.

In additional embodiments, the compositions of the invention are for use in treating or preventing neutrophilic asthma (or non-eosinophilic asthma). High neutrophil numbers are associated with severe asthma that may be insensitive to corticosteroid treatment. Compositions that reduce or inhibit neutrophil recruitment or activation may be useful for treating or preventing neutrophilic asthma.

Eosinophilic and neutrophilic asthma are not mutually exclusive conditions and treatments that help address either the eosinophil and neutrophil responses may be useful for treating asthma in general.

Increased IL-17 levels and activation of the Th17 pathway are associated with severe asthma, so the compositions of the invention may be useful for preventing the development of severe asthma or for treating severe asthma.

In certain embodiments, the compositions of the invention are for use in methods reducing an eosinophilic inflammatory response in the treatment or prevention of asthma, or for use in methods of reducing a neutrophilic inflammatory response in the treatment or prevention of asthma. As noted above, high levels of eosinophils in asthma is associated pathologically with thickening of the basement membrane zone, so reducing eosinophilic inflammatory response in the treatment or prevention of asthma may be able to specifically address this feature of the disease. Also, elevated neutrophils, either in combination with elevated eosinophils or in their absence, is associated with severe asthma and chronic airway narrowing. Therefore, reducing the neutrophilic inflammatory response may be particularly useful for addressing severe asthma.

In certain embodiments, the compositions reduce peribronchiolar infiltration in allergic asthma, or are for use in reducing peribronchiolar infiltration in the treatment of allergic asthma. In certain embodiments, the compositions reduce peribronchiolar and/or perivascular infiltration in neutrophilic asthma, or are for use in reducing peribronchiolar and/or perivascular infiltration in the treatment of allergic neutrophilic asthma.

In certain embodiments, treatment with compositions of the invention provides a reduction or prevents an elevation in TNFα levels.

In certain embodiments, the compositions of the invention are for use in a method of treating asthma that results in a reduction of the eosinophilic and/or neutrophilic inflammatory response. In certain embodiments, the patient to be treated has, or has previously been identified as having, elevated neutrophil or eosinophil levels, for example as identified through blood sampling or sputum analysis.

The compositions of the invention may be useful for preventing the development of asthma in a new-born when administered to the new-born, or to a pregnant woman. The compositions may be useful for preventing the development of asthma in children. The compositions of the invention may be useful for treating or preventing adult-onset asthma. The compositions of the invention may be useful for managing or alleviating asthma. The compositions of the invention may be particularly useful for reducing symptoms associated with asthma that is aggravated by allergens, such as house dust mites.

Treatment or prevention of asthma may refer to, for example, an alleviation of the severity of symptoms or a reduction in the frequency of exacerbations or the range of triggers that are a problem for the patient.

Arthritis

In preferred embodiments, the compositions of the invention are for use in treating or preventing rheumatoid arthritis (RA). The examples demonstrate that the compositions of the invention achieve a reduction in the clinical signs of RA in a mouse model, reduce cartilage and bone damage, and reduce the IL-17 inflammatory response, and so they may be useful in the treatment or prevention of RA. RA is a systemic inflammatory disorder that primarily affects joints. RA is associated with an inflammatory response that results in swelling of joints, synovial hyperplasia, and destruction of cartilage and bone. IL-17 and Th17 cells may have a key role in RA, for example because IL-17 inhibits matrix production in chondrocytes and osteoblasts and activates the production and function of matrix metalloproteinases and because RA disease activity is correlated to IL-17 levels and Th-17 cell numbers [29,30], so the compositions of the invention may be particularly effective for preventing or treating RA.

In certain embodiments, the compositions of the invention are for use in lowering IL-17 levels or preventing elevation of IL-17 levels in the treatment or prevention of RA. In certain embodiments, treatment with compositions of the invention provides a reduction or prevents an elevation in IL-17 levels, in particular IL-17A levels. In certain embodiments, treatment with compositions of the invention provides a reduction or prevents an elevation in IFN-γ or IL-6 levels.

In certain embodiments, treatment with the compositions of the invention results in a reduction in the swelling of joints. In certain embodiments, the compositions of the invention are for use in patients with swollen joints or patients identified as at risk of having swollen joints. In certain embodiments, the compositions of the invention are for use in a method of reducing joint swelling in RA.

In certain embodiments, treatment with the compositions of the invention results in a reduction in cartilage damage or bone damage. In certain embodiments, the compositions of the invention are for use in reducing or preventing cartilage or bone damage in the treatment of RA. In certain embodiments, the compositions are for use in treating patient with severe RA that are at risk of cartilage or bone damage.

Increased IL-17 levels and Th17 cell numbers are associated with cartilage and bone destruction in RA [29,30]. IL-17 is known to activate matrix destruction in cartilage and bone tissue and IL-17 has an inhibitory effect on matrix production in chondrocytes and osteoblasts. Therefore, in certain embodiments, the compositions of the invention are for use in preventing bone erosion or cartilage damage in the treatment of RA. In certain embodiments, the compositions are for use in treating patients that exhibit bone erosion or cartilage damage or patients identified as at risk of bone erosion or cartilage damage.

TNF-α is also associated with RA, but TNF-α is not involved in the pathogenesis of the later stages of the disease. In contrast, IL-17 has a role throughout all stages of chronic disease [31]. Therefore, in certain embodiments the compositions of the invention are for use in treating chronic RA or late-stage RA, such as disease that includes joint destruction and loss of cartilage. In certain embodiments, the compositions of the invention are for treating patients that have previously received anti-TNF-α therapy. In certain embodiments, the patients to be treated do not respond or no longer respond to anti-TNF-α therapy.

The compositions of the invention may be useful for modulating a patient's immune system, so in certain embodiments the compositions of the invention are for use in preventing RA in a patient that has been identified as at risk of RA, or that has been diagnosed with early-stage RA. The compositions of the invention may be useful for preventing the development of RA.

The compositions of the invention may be useful for managing or alleviating RA. The compositions of the invention may be particularly useful for reducing symptoms associated with joint swelling or bone destruction. Treatment or prevention of RA may refer to, for example, an alleviation of the severity of symptoms or a reduction in the frequency of exacerbations or the range of triggers that are a problem for the patient.

Multiple Sclerosis

In preferred embodiments, the compositions of the invention are for use in treating or preventing multiple sclerosis. The examples demonstrate that the compositions of the invention achieve a reduction in the disease incidence and disease severity in a mouse model of multiple sclerosis (the EAE model), and so they may be useful in the treatment or prevention of multiple sclerosis. Multiple sclerosis is an inflammatory disorder associated with damage to the myelin sheaths of neurons, particularly in the brain and spinal column. Multiple sclerosis is a chronic disease, which is progressively incapacitating and which evolves in episodes. IL-17 and Th17 cells may have a key role in multiple sclerosis, for example because IL-17 levels may correlate with multiple sclerosis lesions, IL-17 can disrupt blood brain barrier endothelial cell tight junctions, and Th17 cells can migrate into the central nervous system and cause neuronal loss [32,33]. Therefore, the compositions of the invention may be particularly effective for preventing or treating multiple sclerosis.

In certain embodiments, treatment with the compositions of the invention results in a reduction in disease incidence or disease severity. In certain embodiments, the compositions of the invention are for use in reducing disease incidence or disease severity. In certain embodiments, treatment with the compositions of the invention prevents a decline in motor function or results in improved motor function. In certain embodiments, the compositions of the invention are for use in preventing a decline in motor function or for use in improving motor function. In certain embodiments, treatment with the compositions of the invention prevents the development of paralysis. In certain embodiments, the compositions of the invention are for use in preventing paralysis in the treatment of multiple sclerosis.

The compositions of the invention may be useful for modulating a patient's immune system, so in certain embodiments the compositions of the invention are for use in preventing multiple sclerosis in a patient that has been identified as at risk of multiple sclerosis, or that has been diagnosed with early-stage multiple sclerosis or "relapsing-remitting" multiple sclerosis. The compositions of the invention may be useful for preventing the development of sclerosis. Indeed, the examples show that administration of compositions of the invention prevented the development of disease in many mice.

The compositions of the invention may be useful for managing or alleviating multiple sclerosis. The compositions of the invention may be particularly useful for reducing symptoms associated with multiple sclerosis. Treatment or prevention of multiple sclerosis may refer to, for example, an alleviation of the severity of symptoms or a reduction in the frequency of exacerbations or the range of triggers that are a problem for the patient.

Uveitis

In preferred embodiments, the compositions of the invention are for use in treating or preventing uveitis. The examples demonstrate that the compositions of the invention achieve a reduction in disease incidence and disease severity in an animal model of uveitis and so they may be useful in the treatment or prevention of uveitis. Uveitis is inflammation of the uvea and can result in retinal tissue destruction. It can present in different anatomical forms (anterior, intermediate, posterior or diffuse) and result from different, but related, causes, including systemic autoimmune disorders. IL-17 and the Th17 pathway are centrally involved in uveitis, so the compositions of the invention may be particularly effective for preventing or treating uveitis. References [34-41] describe elevated serum levels of interleukin-17A in uveitis patients, specific association of IL17A genetic variants with panuveitis, the role of Th17-associated cytokines in the pathogenesis of experimental autoimmune uveitis, the imbalance between Th17 Cells and regulatory T Cells during monophasic experimental autoimmune uveitis, the up-regulation of IL-17A in patients with uveitis and active Adamantiades-Behcet and Vogt-Koyanagi-Harada (VKH) diseases, the treatment of non-infectious uveitis with secukinumab (anti-IL-17A antibody), and Th17 in uveitic eyes.

In certain embodiments, the uveitis is posterior uveitis. Posterior uveitis presents primarily with inflammation of the retina and choroid and the examples demonstrate that the compositions of the invention are effective for reducing retinal inflammation and damage.

In certain embodiments, treatment with the compositions of the invention results in a reduction in retinal damage. In certain embodiments, the compositions of the invention are for use in reducing or preventing retinal damage in the treatment of uveitis. In certain embodiments, the compositions are for use in treating patients with severe uveitis that are at risk of retinal damage. In certain embodiments, treatment with the compositions of the invention results in a reduction in optic disc inflammation. In certain embodiments, the compositions of the invention are for use in reducing or preventing optic disc inflammation. In certain embodiments, treatment with the compositions of the invention results in a reduction in retinal tissue infiltration by inflammatory cells. In certain embodiments, the compositions of the invention are for use in reducing retinal tissue infiltration by inflammatory cells. In certain embodiments, treatment with the compositions of the invention results in vision being maintained or improved. In certain embodiments, the compositions of the invention are for use in maintaining or improving vision.

In certain embodiments, the compositions are for use in treating or preventing uveitis associated with a non-infectious or autoimmune disease, such as Behcet disease, Crohn's disease, Fuchs heterochromic iridocyclitis, granulomatosis with polyangiitis, HLA-B27 related uveitis, juvenile idiopathic arthritis, sarcoidosis, spondyloarthritis, sympathetic ophthalmia, tubulointerstitial nephritis and uveitis syndrome or Vogt-Koyanagi-Harada syndrome. IL-17A has been shown to be involved in, for example, Behcet and Vogt-Koyanagi-Harada diseases.

Treatment or prevention of uveitis may refer to, for example, an alleviation of the severity of symptoms or a prevention of relapse.

Cancer

In preferred embodiments, the compositions of the invention are for use in treating or preventing cancer. IL-17 and the Th17 pathway have central roles in cancer development and progression, and so the compositions of the invention may be useful for treating or preventing cancer.

Although the roles of IL-17 and Th17 cells in cancer are not fully understood, numerous pro-tumour effects of IL-17 and Th17 cells are known. For example, Th17 cells and IL-17 can promote angiogenesis, increase proliferation and survival of tumor cells and activate tumour-promoting transcription factors [42-44].

In certain embodiments, treatment with the compositions of the invention results in a reduction in tumour size or a reduction in tumour growth. In certain embodiments, the compositions of the invention are for use in reducing tumour size or reducing tumour growth. The compositions of the invention may be effective for reducing tumour size or growth. In certain embodiments, the compositions of the invention are for use in patients with solid tumours. In certain embodiments, the compositions of the invention are for use in reducing or preventing angiogenesis in the treatment of cancer. IL-17 and Th17 cells have central roles in angiogenesis. In certain embodiments, the compositions of the invention are for use in preventing metastasis.

In certain embodiments, the compositions of the invention are for use in treating or preventing breast cancer. The compositions of the invention may be effective for treating breast cancer, and IL-17 and Th17 cells have important roles in breast cancer [45]. In certain embodiments, the compositions of the invention are for use in reducing tumour size, reducing tumour growth, or reducing angiogenesis in the treatment of breast cancer. In preferred embodiments the cancer is mammary carcinoma. In preferred embodiments the cancer is stage IV breast cancer.

In certain embodiments, the compositions of the invention are for use in treating or preventing lung cancer. The compositions of the invention may be effective for treating lung cancer, and IL-17 and Th17 cells have important roles in lung cancer [46]. In certain embodiments, the compositions of the invention are for use in reducing tumour size, reducing tumour growth, or reducing angiogenesis in the treatment of lung cancer. In preferred embodiments the cancer is lung carcinoma.

In certain embodiments, the compositions of the invention are for use in treating or preventing liver cancer. The compositions of the invention may be effective for treating liver cancer, and IL-17 and Th17 cells have important roles in liver cancer [47]. In certain embodiments, the compositions of the invention are for use in reducing tumour size, reducing tumour growth, or reducing angiogenesis in the treatment of liver cancer. In preferred embodiments the cancer is hepatoma (hepatocellular carcinoma).

In certain embodiments, the compositions of the invention are for use in treating or preventing carcinoma. The compositions of the invention may be particularly effective for treating carcinoma. In certain embodiments, the compositions of the invention are for use in treating or preventing non-immunogenic cancer. The compositions of the invention may be effective for treating non-immunogenic cancers.

In further embodiments, the compositions of the invention are for use in treating or preventing acute lymphoblastic leukemia (ALL), acute myeloid leukemia, adrenocortical carcinoma, basal-cell carcinoma, bile duct cancer, bladder cancer, bone tumor, osteosarcoma/malignant fibrous histiocytoma, brainstem glioma, brain tumor, cerebellar astrocytoma, cerebral astrocytoma/malignant glioma, ependymoma, medulloblastoma, supratentorial primitive neuroectodermal tumors, breast cancer, bronchial adenomas/carcinoids, Burkitt's lymphoma, carcinoid tumor, cervical cancer, chronic lymphocytic leukemia, chronic myelogenous leukemia, chronic myeloproliferative disorders, colon cancer, cutaneous T-cell lymphoma, endometrial cancer, ependymoma, esophageal cancer, Ewing's sarcoma, intraocular melanoma, retinoblastoma, gallbladder cancer, gastric cancer, gastrointestinal carcinoid tumor, gastrointestinal stromal tumor (GIST), germ cell tumor, glioma, childhood visual pathway and hypothalamic, Hodgkin lymphoma, melanoma, islet cell carcinoma, Kaposi sarcoma, renal cell cancer, laryngeal cancer, leukaemias, lymphomas, mesothelioma, neuroblastoma, non-Hodgkin lymphoma, oropharyngeal cancer, osteosarcoma, ovarian cancer, pancreatic cancer, parathyroid cancer, pharyngeal cancer, pituitary adenoma, plasma cell neoplasia, prostate cancer, renal cell carcinoma, retinoblastoma, sarcoma, testicular cancer, thyroid cancer, or uterine cancer.

The compositions of the invention may be particularly effective when used in combination with further therapeutic agents. The immune-modulatory effects of the compositions of the invention may be effective when combined with more direct anti-cancer agents. Therefore, in certain embodiments, the invention provides a composition comprising a bacterial strain of the genus *Blautia* and an anticancer agent. In preferred embodiments the anticancer agent is an immune checkpoint inhibitor, a targeted antibody immunotherapy, a CAR-T cell therapy, an oncolytic virus, or a cytostatic drug. In preferred embodiments, the composition comprises an anti-cancer agent selected from the group consisting of: Yervoy (ipilimumab, BMS); Keytruda (pembrolizumab, Merck); Opdivo (nivolumab, BMS); MEDI4736 (AZ/MedImmune); MPDL3280A (Roche/Genentech); Tremelimumab (AZ/MedImmune); CT-011 (pidilizumab, CureTech); BMS-986015 (lirilumab, BMS); MEDI0680 (AZ/MedImmune); MSB-0010718C (Merck); PF-05082566 (Pfizer); MEDI6469 (AZ/MedImmune); BMS-986016 (BMS); BMS-663513 (urelumab, BMS); IMP321 (Prima Biomed); LAG525 (Novartis); ARGX-110 (arGEN-X); PF-05082466 (Pfizer); CDX-1127 (varlilumab; CellDex Therapeutics); TRX-518 (GITR Inc.); MK-4166 (Merck); JTX-2011 (Jounce Therapeutics); ARGX-115 (arGEN-X); NLG-9189 (indoximod, NewLink Genetics); INCB024360 (Incyte); IPH2201 (Innate Immotherapeutics/AZ); NLG-919 (NewLink Genetics); anti-VISTA (JnJ); Epacadostat (INCB24360, Incyte); F001287 (Flexus/BMS); CP 870893 (University of Pennsylvania); MGA271 (Macrogenix); Emactuzumab (Roche/Genentech); Galunisertib (Eli Lilly); Ulocuplumab (BMS); BKT140/BL8040 (Biokine Therapeutics); Bavituximab (Peregrine Pharmaceuticals); CC 90002 (Celgene); 852A (Pfizer); VTX-2337 (VentiRx Pharmaceuticals); IMO-2055 (Hybridon, Idera Pharmaceuticals); LY2157299 (Eli Lilly); EW-7197 (Ewha Women's University, Korea); Vemurafenib (Plexxikon); Dabrafenib (Genentech/GSK); BMS-777607 (BMS); BLZ945 (Memorial Sloan-Kettering Cancer Centre); Unituxin (dinutuximab, United Therapeutics Corporation); Blincyto (blinatumomab, Amgen); Cyramza (ramucirumab, Eli Lilly); Gazyva (obinutuzumab, Roche/Biogen); Kadcyla (ado-trastuzumab emtansine, Roche/Genentech); Perjeta (pertuzumab, Roche/Genentech); Adcetris (brentuximab vedotin, Takeda/Millennium); Arzerra (ofatumumab, GSK); Vectibix (panitumumab, Amgen); Avastin (bevacizumab, Roche/Genentech); Erbitux (cetuximab, BMS/Merck); Bexxar (tositumomab-I131, GSK); Zevalin (ibritumomab tiuxetan, Biogen); Campath (alemtuzumab, Bayer); Mylotarg (gemtuzumab ozogamicin, Pfizer); Herceptin (trastuzumab, Roche/Genentech); Rituxan (rituximab, Genentech/Biogen); voliciximab (Abbvie); Enavatuzumab (Abbvie); ABT-414 (Abbvie); Elotuzumab (Abbvie/BMS); ALX-0141 (Ablynx); Ozaralizumab (Ablynx); Actimab-C (Actinium); Actimab-P (Actinium); Milatuzumab-dox (Actinium); Emab-SN-38 (Actinium); Naptumonmab estafenatox (Active Biotech); AFM13 (Affimed); AFM11 (Affimed); AGS-16C3F (Agensys); AGS-16M8F (Agensys); AGS-22ME (Agensys); AGS-15ME (Agensys); GS-67E (Agensys); ALXN6000 (samalizumab, Alexion); ALT-836 (Altor Bioscience); ALT-801 (Altor Bioscience); ALT-803 (Altor Bioscience); AMG780 (Amgen); AMG 228 (Amgen); AMG820 (Amgen); AMG172 (Amgen); AMG595 (Amgen); AMG110 (Amgen); AMG232 (adecatumumab, Amgen); AMG211 (Amgen/MedImmune); BAY20-10112 (Amgen/Bayer); Rilotumumab (Amgen); Denosumab (Amgen); AMP-514 (Amgen); MEDI575 (AZ/MedImmune); MEDI3617 (AZ/MedImmune); MEDI6383 (AZ/MedImmune); MEDI551 (AZ/MedImmune); Moxetumomab pasudotox (AZ/MedImmune); MEDI565 (AZ/MedImmune); MEDI0639 (AZ/MedImmune); MEDI0680 (AZ/MedImmune); MEDI562 (AZ/MedImmune); AV-380 (AVEO); AV203 (AVEO); AV299 (AVEO); BAY79-4620 (Bayer); Anetumab ravtansine (Bayer); vanticumab (Bayer); BAY94-9343 (Bayer); Sibrotuzumab (Boehringer Ingleheim); BI-836845 (Boehringer Ingleheim); B-701 (BioClin); BIIB015 (Biogen); Obinutuzumab (Biogen/Genentech); BI-505 (Bioinvent); BI-1206 (Bioinvent); TB-403 (Bioinvent); BT-062 (Biotest) BIL-010t (Biosceptre); MDX-1203 (BMS); MDX-1204 (BMS); Necitumumab (BMS); CAN-4 (Cantargia AB); CDX-011 (Celldex); CDX1401 (Celldex); CDX301 (Celldex); U3-1565 (Daiichi Sankyo); patritumab (Daiichi Sankyo); tigatuzumab (Daiichi Sankyo); nimotuzumab (Daiichi Sankyo); DS-8895 (Daiichi Sankyo); DS-8873 (Daiichi Sankyo); DS-5573 (Daiichi Sankyo); MORab-004 (Eisai); MORab-009 (Eisai); MORab-003 (Eisai); MORab-066 (Eisai); LY3012207 (Eli Lilly); LY2875358 (Eli Lilly); LY2812176 (Eli Lilly); LY3012217 (Eli Lilly); LY2495655 (Eli Lilly); LY3012212 (Eli Lilly); LY3012211 (Eli Lilly); LY3009806 (Eli Lilly); cixutumumab (Eli Lilly); Flanvotumab (Eli Lilly); IMC-TR1 (Eli Lilly); Ramucirumab (Eli Lilly); Tabalumab (Eli Lilly); Zanolimumab (Emergent Biosolution); FG-3019 (FibroGen); FPA008 (Five Prime Therapeutics); FP-1039 (Five Prime Therapeutics); FPA144 (Five Prime Therapeutics); catumaxomab (Fresenius Biotech); IMAB362 (Ganymed); IMAB027 (Ganymed); HuMax-CD74 (Genmab); HuMax-TFADC (Genmab); GS-5745 (Gilead); GS-6624 (Gilead); OMP-21M18 (demcizumab, GSK); mapatumumab (GSK); IMGN289 (ImmunoGen); IMGN901 (ImmunoGen); IMGN853 (ImmunoGen); IMGN529 (ImmunoGen); IMMU-130 (Immunomedics); milatuzumab-dox (Immunomedics); IMMU-115 (Immunomedics); IMMU-132 (Immunomedics); IMMU-106 (Immunomedics); IMMU-102 (Immunomedics); Epratuzumab (Immunomedics); Clivatuzumab (Immunomedics); IPH41 (Innate Immunotherapeutics); Daratumumab (Janssen/Genmab); CNTO-95 (Intetumumab, Janssen); CNTO-328 (siltuximab, Janssen); KB004 (KaloBios); mogamulizumab (Kyowa Hakko Kirrin); KW-2871 (ecromeximab, Life Science); Sonepcizumab (Lpath); Margetuximab (Macrogenics); Enoblituzumab (Macrogenics); MGD006 (Macrogenics); MGF007 (Macrogenics); MK-0646 (dalotuzumab, Merck); MK-3475 (Merck); Sym004 (Symphogen/Merck Serono); DI17E6 (Merck Serono); MOR208 (Morphosys); MOR202 (Morphosys); Xmab5574 (Morphosys); BPC-1C (ensituximab, Precision Biologics); TAS266 (Novartis); LFA102 (Novartis); BHQ880 (Novartis/Morphosys); QGE031 (Novartis); HCD122 (lucatumumab, Novartis); LJM716 (Novartis); AT355 (Novartis); OMP-21M18 (Demcizumab, OncoMed); OMP52M51 (Oncomed/GSK); OMP-59R5 (Oncomed/GSK); vantictumab (Oncomed/Bayer); CMC-544 (inotuzumab ozogamicin, Pfizer); PF-03446962 (Pfizer); PF-04856884 (Pfizer); PSMA-ADC (Progenics); REGN1400 (Regeneron); REGN910 (nesvacumab, Regeneron/Sanofi); REGN421 (enoticumab, Regeneron/Sanofi); RG7221, RG7356, RG7155, RG7444, RG7116, RG7458, RG7598, RG7599, RG7600, RG7636, RG7450, RG7593, RG7596, DCDS3410A, RG7414 (parsatuzumab), RG7160 (imgatuzumab), RG7159 (obinutuzumab), RG7686, RG3638 (onartuzumab), RG7597 (Roche/Genentech); SAR307746 (Sanofi); SAR566658 (Sanofi); SAR650984 (Sanofi); SAR153192 (Sanofi); SAR3419 (Sanofi); SAR256212 (Sanofi), SGN-LIV1A (lintuzumab, Seattle Genetics); SGN-CD33A (Seattle Genetics); SGN-75 (vorsetuzumab mafodotin, Seattle Genetics); SGN-19A (Seattle Genetics) SGN-CD70A (Seattle Genetics); SEA-CD40 (Seattle Genetics); ibritumomab tiuxetan (Spectrum); MLN0264 (Takeda); ganitumab (Takeda/Amgen); CEP-37250 (Teva); TB-403 (Thrombogenic); VB4-845 (Viventia); Xmab2512 (Xencor); Xmab5574 (Xencor); nimotuzumab (YM Biosciences); Carlumab (Janssen); NY-ESO TCR (Adaptimmune); MAGE-A-10 TCR (Adaptimmune); CTL019 (Novartis); JCAR015 (Juno Therapeutics); KTE-C19 CAR (Kite Pharma); UCART19 (Cellectis); BPX-401 (Bellicum Pharmaceuticals); BPX-601 (Bellicum Pharmaceuticals); ATTCK20 (Unum Therapeutics); CAR-NKG2D (Celyad); Onyx-015 (Onyx Pharmaceuticals); H101 (Shanghai Sunwaybio); DNX-2401 (DNAtrix); VCN-01 (VCN Biosciences); Colo-Adl (PsiOxus Therapeutics); ProstAtak (Advantagene); Oncos-102 (Oncos Therapeutics); CG0070 (Cold Genesys); Pexa-vac (JX-594, Jennerex Biotherapeutics); GL-ONC1 (Genelux); T-VEC (Amgen); G207 (Medigene); HF10 (Takara Bio); SEPREHVIR (HSV1716, Virttu Biologics); OrienX010 (OrienGene Biotechnology); Reolysin (Oncolytics Biotech); SVV-001 (Neotropix); Cacatak (CVA21, Viralytics); Alimta (Eli Lilly), cisplatin, oxaliplatin, irinotecan, folinic acid, methotrexate, cyclophosphamide, 5-fluorouracil, Zykadia (Novartis), Tafinlar (GSK), Xalkori (Pfizer), Iressa (AZ), Gilotrif (Boehringer Ingelheim), Tarceva (Astellas Pharma), Halaven (Eisai Pharma), Veliparib (Abbvie), AZD9291 (AZ), Alectinib (Chugai), LDK378 (Novartis), Genetespib (Synta Pharma), Tergenpumatucel-L (NewLink Genetics), GV1001 (Kael-GemVax), Tivantinib (ArQule); Cytoxan (BMS); Oncovin (Eli Lilly); Adriamycin (Pfizer); Gemzar (Eli Lilly); Xeloda (Roche); Ixempra (BMS); Abraxane (Celgene); Trelstar (Debiopharm); Taxotere (Sanofi); Nexavar (Bayer); IMMU-132 (Immunomedics); E7449 (Eisai); Thermodox (Celsion); Cometriq (Exellxis); Lonsurf (Taiho Pharmaceuticals); Camptosar (Pfizer); UFT (Taiho Pharmaceuticals); and TS-1 (Taiho Pharmaceuticals).

Modes of Administration

Preferably, the compositions of the invention are to be administered to the gastrointestinal tract in order to enable delivery to and/or partial or total colonisation of the intestine with the bacterial strain of the invention. Generally, the compositions of the invention are administered orally, but they may be administered rectally, intranasally, or via buccal or sublingual routes.

In certain embodiments, the compositions of the invention may be administered as a foam, as a spray or a gel.

In certain embodiments, the compositions of the invention may be administered as a suppository, such as a rectal suppository, for example in the form of a theobroma oil (cocoa butter), synthetic hard fat (e.g. suppocire, witepsol), glycero-gelatin, polyethylene glycol, or soap glycerin composition.

In certain embodiments, the composition of the invention is administered to the gastrointestinal tract via a tube, such as a nasogastric tube, orogastric tube, gastric tube, jejunostomy tube (J tube), percutaneous endoscopic gastrostomy (PEG), or a port, such as a chest wall port that provides access to the stomach, jejunum and other suitable access ports.

The compositions of the invention may be administered once, or they may be administered sequentially as part of a treatment regimen. In certain embodiments, the compositions of the invention are to be administered daily.

In certain embodiments of the invention, treatment according to the invention is accompanied by assessment of the patient's gut microbiota. Treatment may be repeated if delivery of and/or partial or total colonisation with the strain of the invention is not achieved such that efficacy is not observed, or treatment may be ceased if delivery and/or partial or total colonisation is successful and efficacy is observed.

In certain embodiments, the composition of the invention may be administered to a pregnant animal, for example a mammal such as a human in order to prevent an inflammatory or autoimmune disease developing in her child in utero and/or after it is born.

The compositions of the invention may be administered to a patient that has been diagnosed with a disease or condition mediated by IL-17 or the Th17 pathway, or that has been identified as being at risk of a disease or condition mediated by IL-17 or the Th17 pathway. The compositions may also be administered as a prophylactic measure to prevent the development of diseases or conditions mediated by IL-17 or the Th17 pathway in a healthy patient.

The compositions of the invention may be administered to a patient that has been identified as having an abnormal gut microbiota. For example, the patient may have reduced or absent colonisation by *Blautia*, and in particular *Blautia stercoris* or *Blautia wexlerae*.

The compositions of the invention may be administered as a food product, such as a nutritional supplement.

Generally, the compositions of the invention are for the treatment of humans, although they may be used to treat animals including monogastric mammals such as poultry, pigs, cats, dogs, horses or rabbits. The compositions of the invention may be useful for enhancing the growth and performance of animals. If administered to animals, oral gavage may be used.

Compositions

Generally, the composition of the invention comprises bacteria. In preferred embodiments of the invention, the composition is formulated in freeze-dried form. For example, the composition of the invention may comprise granules or gelatin capsules, for example hard gelatin capsules, comprising a bacterial strain of the invention.

Preferably, the composition of the invention comprises lyophilised bacteria. Lyophilisation of bacteria is a well-established procedure and relevant guidance is available in, for example, references [48-50].

Alternatively, the composition of the invention may comprise a live, active bacterial culture.

In preferred embodiments, the composition of the invention is encapsulated to enable delivery of the bacterial strain to the intestine. Encapsulation protects the composition from degradation until delivery at the target location through, for example, rupturing with chemical or physical stimuli such as pressure, enzymatic activity, or physical disintegration, which may be triggered by changes in pH. Any appropriate encapsulation method may be used. Exemplary encapsulation techniques include entrapment within a porous matrix, attachment or adsorption on solid carrier surfaces, self-aggregation by flocculation or with cross-linking agents, and mechanical containment behind a microporous membrane or a microcapsule. Guidance on encapsulation that may be useful for preparing compositions of the invention is available in, for example, references [51] and [52].

The composition may be administered orally and may be in the form of a tablet, capsule or powder. Encapsulated products are preferred because *Blautia* are anaerobes. Other ingredients (such as vitamin C, for example), may be included as oxygen scavengers and prebiotic substrates to improve the delivery and/or partial or total colonisation and survival in vivo. Alternatively, the probiotic composition of the invention may be administered orally as a food or nutritional product, such as milk or whey based fermented dairy product, or as a pharmaceutical product.

The composition may be formulated as a probiotic.

A composition of the invention includes a therapeutically effective amount of a bacterial strain of the invention. A therapeutically effective amount of a bacterial strain is sufficient to exert a beneficial effect upon a patient. A therapeutically effective amount of a bacterial strain may be sufficient to result in delivery to and/or partial or total colonisation of the patient's intestine.

A suitable daily dose of the bacteria, for example for an adult human, may be from about $1 \times 10^3$ to about $1 \times 10^{11}$ colony forming units (CFU); for example, from about $1 \times 10^7$ to about $1 \times 10^{10}$ CFU; in another example from about $1 \times 10^6$ to about $1 \times 10^{10}$ CFU.

In certain embodiments, the composition contains the bacterial strain in an amount of from about $1 \times 10^6$ to about $1 \times 10^{11}$ CFU/g, respect to the weight of the composition; for example, from about $1 \times 10^8$ to about $1 \times 10^{10}$ CFU/g. The dose may be, for example, 1 g, 3 g, 5 g, and 10 g.

Typically, a probiotic, such as the composition of the invention, is optionally combined with at least one suitable prebiotic compound. A prebiotic compound is usually a non-digestible carbohydrate such as an oligo- or polysaccharide, or a sugar alcohol, which is not degraded or absorbed in the upper digestive tract. Known prebiotics include commercial products such as inulin and transgalacto-oligosaccharides.

In certain embodiments, the probiotic composition of the present invention includes a prebiotic compound in an amount of from about 1 to about 30% by weight, respect to the total weight composition, (e.g. from 5 to 20% by weight). Carbohydrates may be selected from the group consisting of: fructo-oligosaccharides (or FOS), short-chain fructo-oligosaccharides, inulin, isomalt-oligosaccharides, pectins, xylo-oligosaccharides (or XOS), chitosan-oligosaccharides (or COS), beta-glucans, arable gum modified and resistant starches, polydextrose, D-tagatose, acacia fibers, carob, oats, and citrus fibers. In one aspect, the prebiotics are the short-chain fructo-oligosaccharides (for simplicity shown herein below as FOSs-c.c); said FOSs-c.c. are not digestible carbohydrates, generally obtained by the conversion of the beet sugar and including a saccharose molecule to which three glucose molecules are bonded.

The compositions of the invention may comprise pharmaceutically acceptable excipients or carriers. Examples of such suitable excipients may be found in the reference [53]. Acceptable carriers or diluents for therapeutic use are well known in the pharmaceutical art and are described, for example, in reference [54]. Examples of suitable carriers include lactose, starch, glucose, methyl cellulose, magnesium stearate, mannitol, sorbitol and the like. Examples of suitable diluents include ethanol, glycerol and water. The choice of pharmaceutical carrier, excipient or diluent can be selected with regard to the intended route of administration and standard pharmaceutical practice. The pharmaceutical compositions may comprise as, or in addition to, the carrier, excipient or diluent any suitable binder(s), lubricant(s), suspending agent(s), coating agent(s), solubilising agent(s). Examples of suitable binders include starch, gelatin, natural sugars such as glucose, anhydrous lactose, free-flow lactose, beta-lactose, corn sweeteners, natural and synthetic gums, such as acacia, tragacanth or sodium alginate, carboxymethyl cellulose and polyethylene glycol. Examples of suitable lubricants include sodium oleate, sodium stearate, magnesium stearate, sodium benzoate, sodium acetate, sodium chloride and the like. Preservatives, stabilizers, dyes and even flavouring agents may be provided in the pharmaceutical composition. Examples of preservatives include sodium benzoate, sorbic acid and esters of p-hydroxybenzoic acid. Antioxidants and suspending agents may be also used.

The compositions of the invention may be formulated as a food product. For example, a food product may provide nutritional benefit in addition to the therapeutic effect of the invention, such as in a nutritional supplement. Similarly, a food product may be formulated to enhance the taste of the composition of the invention or to make the composition more attractive to consume by being more similar to a common food item, rather than to a pharmaceutical composition. In certain embodiments, the composition of the invention is formulated as a milk-based product. The term "milk-based product" means any liquid or semi-solid milk- or whey-based product having a varying fat content. The milk-based product can be, e.g., cow's milk, goat's milk, sheep's milk, skimmed milk, whole milk, milk recombined from powdered milk and whey without any processing, or a processed product, such as yoghurt, curdled milk, curd, sour milk, sour whole milk, butter milk and other sour milk products. Another important group includes milk beverages, such as whey beverages, fermented milks, condensed milks, infant or baby milks; flavoured milks, ice cream; milk-containing food such as sweets.

In certain embodiments, the compositions of the invention contain a single bacterial strain or species and do not contain any other bacterial strains or species. Such compositions may comprise only de minimis or biologically irrelevant amounts of other bacterial strains or species. Such compositions may be a culture that is substantially free from other species of organism.

The compositions for use in accordance with the invention may or may not require marketing approval.

In some cases, the lyophilised bacterial strain is reconstituted prior to administration. In some cases, the reconstitution is by use of a diluent described herein.

The compositions of the invention can comprise pharmaceutically acceptable excipients, diluents or carriers.

In certain embodiments, the invention provides a pharmaceutical composition comprising: a bacterial strain of the invention; and a pharmaceutically acceptable excipient, carrier or diluent; wherein the bacterial strain is in an amount sufficient to treat a disorder when administered to a subject in need thereof; and wherein the disorder is selected from the group consisting of asthma, allergic asthma, neutrophilic asthma, osteoarthritis, psoriatic arthritis, juvenile idiopathic arthritis, neuromyelitis optica (Devic's disease), ankylosing spondylitis, spondyloarthritis, systemic lupus erythematosus, celiac disease, chronic obstructive pulmonary disease (COPD), cancer, breast cancer, colon cancer, lung cancer, ovarian cancer, uveitis, scleritis, vasculitis, Behcet's disease, atherosclerosis, atopic dermatitis, emphysema, periodontitis, allergic rhinitis, and allograft rejection.

In certain embodiments, the invention provides pharmaceutical composition comprising: a bacterial strain of the invention; and a pharmaceutically acceptable excipient, carrier or diluent; wherein the bacterial strain is in an amount sufficient to treat or prevent a disease or condition mediated by IL-17 or the Th17 pathway. In preferred embodiments, said disease or condition is selected from the group consisting of rheumatoid arthritis, multiple sclerosis, psoriasis, inflammatory bowel disease, Crohn's disease, ulcerative colitis, celiac disease, asthma, allergic asthma, neutrophilic asthma, osteoarthritis, psoriatic arthritis, juvenile idiopathic arthritis, neuromyelitis optica (Devic's disease), ankylosing spondylitis, spondyloarthritis, systemic lupus erythematosus, chronic obstructive pulmonary disease (COPD), cancer, breast cancer, colon cancer, lung cancer, ovarian cancer, uveitis, scleritis, vasculitis, Behcet's disease, atherosclerosis, atopic dermatitis, emphysema, periodontitis, allergic rhinitis, and allograft rejection.

In certain embodiments, the invention provides the above pharmaceutical composition, wherein the amount of the bacterial strain is from about $1\times10^3$ to about $1\times10^{11}$ colony forming units per gram with respect to a weight of the composition.

In certain embodiments, the invention provides the above pharmaceutical composition, wherein the composition is administered at a dose of 1 g, 3 g, 5 g or 10 g.

In certain embodiments, the invention provides the above pharmaceutical composition, wherein the composition is administered by a method selected from the group consisting of oral, rectal, subcutaneous, nasal, buccal, and sublingual.

In certain embodiments, the invention provides the above pharmaceutical composition, comprising a carrier selected from the group consisting of lactose, starch, glucose, methyl cellulose, magnesium stearate, mannitol and sorbitol.

In certain embodiments, the invention provides the above pharmaceutical composition, comprising a diluent selected from the group consisting of ethanol, glycerol and water.

In certain embodiments, the invention provides the above pharmaceutical composition, comprising an excipient selected from the group consisting of starch, gelatin, glucose, anhydrous lactose, free-flow lactose, beta-lactose, corn sweetener, acacia, tragacanth, sodium alginate, carboxymethyl cellulose, polyethylene glycol, sodium oleate, sodium stearate, magnesium stearate, sodium benzoate, sodium acetate and sodium chloride.

In certain embodiments, the invention provides the above pharmaceutical composition, further comprising at least one of a preservative, an antioxidant and a stabilizer.

In certain embodiments, the invention provides the above pharmaceutical composition, comprising a preservative selected from the group consisting of sodium benzoate, sorbic acid and esters of p-hydroxybenzoic acid.

In certain embodiments, the invention provides the above pharmaceutical composition, wherein said bacterial strain is lyophilised.

In certain embodiments, the invention provides the above pharmaceutical composition, wherein when the composition is stored in a sealed container at about 4.0 or about 25.0 and the container is placed in an atmosphere having 50% relative humidity, at least 80% of the bacterial strain as measured in colony forming units, remains after a period of at least about: 1 month, 3 months, 6 months, 1 year, 1.5 years, 2 years, 2.5 years or 3 years.

Culturing Methods

The bacterial strains for use in the present invention can be cultured using standard microbiology techniques as detailed in, for example, references [55-57].

The solid or liquid medium used for culture may be YCFA agar or YCFA medium. YCFA medium may include (per 100 ml, approximate values): Casitone (1.0 g), yeast extract (0.25 g), $NaHCO_3$ (0.4 g), cysteine (0.1 g), $K_2HPO_4$ (0.045 g), $KH_2PO_4$ (0.045 g), NaCl (0.09 g), $(NH_4)_2SO_4$ (0.09 g), $MgSO_4 \cdot 7H_2O$ (0.009 g), $CaCl_2$ (0.009 g), resazurin (0.1 mg), hemin (1 mg), biotin (1 µg), cobalamin (1 µg), p-aminobenzoic acid (3 µg), folic acid (5 µg), and pyridoxamine (15 µg).

Bacterial Strains for Use in Vaccine Compositions

The inventors have identified that the bacterial strains of the invention are useful for treating or preventing diseases or conditions mediated by IL-17 or the Th17 pathway. This is likely to be a result of the effect that the bacterial strains of the invention have on the host immune system. Therefore, the compositions of the invention may also be useful for preventing diseases or conditions mediated by IL-17 or the Th17 pathway, when administered as vaccine compositions. In certain such embodiments, the bacterial strains of the invention may be killed, inactivated or attenuated. In certain such embodiments, the compositions may comprise a vaccine adjuvant. In certain embodiments, the compositions are for administration via injection, such as via subcutaneous injection.

General

The practice of the present invention will employ, unless otherwise indicated, conventional methods of chemistry, biochemistry, molecular biology, immunology and pharmacology, within the skill of the art. Such techniques are explained fully in the literature. See, e.g., references [58] and [59-65], etc.

The term "comprising" encompasses "including" as well as "consisting" e.g. a composition "comprising" X may consist exclusively of X or may include something additional e.g. X+Y.

The term "about" in relation to a numerical value x is optional and means, for example, x±10%.

The word "substantially" does not exclude "completely" e.g. a composition which is "substantially free" from Y may be completely free from Y. Where necessary, the word "substantially" may be omitted from the definition of the invention.

References to a percentage sequence identity between two nucleotide sequences means that, when aligned, that percentage of nucleotides are the same in comparing the two sequences. This alignment and the percent homology or sequence identity can be determined using software programs known in the art, for example those described in section 7.7.18 of ref [66]. A preferred alignment is determined by the Smith-Waterman homology search algorithm using an affine gap search with a gap open penalty of 12 and a gap extension penalty of 2, BLOSUM matrix of 62. The Smith-Waterman homology search algorithm is disclosed in ref. [67].

Unless specifically stated, a process or method comprising numerous steps may comprise additional steps at the beginning or end of the method, or may comprise additional intervening steps. Also, steps may be combined, omitted or performed in an alternative order, if appropriate.

Various embodiments of the invention are described herein. It will be appreciated that the features specified in each embodiment may be combined with other specified features, to provide further embodiments. In particular, embodiments highlighted herein as being suitable, typical or preferred may be combined with each other (except when they are mutually exclusive).

MODES FOR CARRYING OUT THE INVENTION

Example 1—Efficacy of Bacterial Inocula in a Mouse Model of House Dust Mite-Induced Asthma Summary Mice were administered with compositions comprising bacterial strains according to the invention and were subsequently challenged with house dust mite (HDM) extract to elicit an allergic inflammatory response. The inflammatory response to HDM includes eosinophilic and neutrophilic components, is mediated by IL-17 and the Th17 pathway, and is a model for asthma. The magnitude and characteristics of the inflammatory response exhibited by mice treated with compositions of the invention were compared to control groups. The compositions of the invention were found to alleviate the inflammatory response, and to reduce recruitment of eosinophils and neutrophils, indicating that they may be useful for treating IL-17- and Th17-mediated conditions such as eosinophilia, neutrophilia and asthma.

Strain

830: *Blautia stercoris*

Study Design

Groups:

1. Negative control group. Treatment with vehicle control (per oral).
6. Treatment with therapeutic bacteria inoculum strain 830 (per oral).
7. Positive control group. Treatment with Dexamethasone (i.p.).
8. Untreated Control Group.

Number of mice per group=5

Day −14 to day 13: Daily administration of vehicle control per oral (Group 1).

Day −14 to day 13: Daily administration of therapeutic bacteria inoculum per oral (Group 2-6).

Day 0, 2, 4, 7, 9, 11 Administration of 15 ug HDM (house dust mite extract—Catalogue number: XPB70D3A25, Lot number: 231897, Greer Laboratories, Lenoir, N.C., USA) in a volume of 30 ul PBS per nasal (Group 1-8).

Day 0, 2, 4, 7, 9, 11 Administration of Dexamethasone (i.p., 3 mg/kg, Sigma-Aldrich, Catalogue number D1159) (Group 7).

Day 14 Sacrifice of all animals for analysis.

Total number of mice=40.

Endpoints and Analysis

On day 14 animals were sacrificed by lethal intraperitoneal injection with pentabarbitol (Streuli Pharma AG, Uznach, Cat: 1170139A) immediately followed by a bronchoalveolar lavage (BAL).

Cells were isolated from the BAL (bronchoalveolar lavage) fluid and differential cell counts performed (200 cell counts/samples).

Material and Methods

Mice.

Female 7 week old BALB/c mice were purchased from Charles River Laboratories and randomly allocated to cages totally 5 mice per cage (Ventilated cages sourced from Indulab AG, Gams, Switzerland Cage type: "The Sealsafe™—IVC cage. Product number 1248L). Cages were labeled with study number, group number and experimental starting date. Mice were monitored weekly and acclimatized to facility for 7 days prior to initiation of study (Study Day −14). Animals were 8 weeks old on Study Day −14. Potable water and food were available ad libitum. Cage enrichment was present. Daily care of the animals was performed according to local authorization license number 2283.1 (issued and approved by: Service de la consommation et des affaires vétérinaires du Canton de Vaud). Potable water and food were available ad libitum and refreshed once daily. Cage enrichment was present. Animal welfare regulations were observed as given by official authorities of Switzerland under ordinance 455.163 of the FVO (Federal Veterinary Office) on laboratory animal husbandry, production of genetically modified animals, and methods of animal experimentation.

Culturing of Bacteria Inoculum.

Within a sterile workstation, a cryo-vial of bacteria was thawed by warming in gloved hand and ~0.7 ml of contents injected into a Hungate tube (Cat Number, 1020471, Glasgerätebau Ochs, Bovenden-Lenglern, Germany), containing 8 ml of anaerobic YCFA. Two tubes per strain were usually prepared. The Hungate tubes were then incubated (static) at 37° C. for up to 24-26 hours (for strain 830).

Culturing of Vehicle Control.

A Hungate tube containing 8 ml of anaerobic YCFA was incubated (static) at 37° C. for 16 h.

Administration of Bacteria Inoculum or Vehicle Control.

400 ul of cultured bacteria inoculum or vehicle control were administered per day per oral gavage.

Intranasal Sensitization.

Mice were anesthetized by i.p. injection with 9.75 mg xylasol and 48.75 mg ketasol per kg (Dr. E. Graeub AG, Bern, Switzerland) and administered with 15 ug of HDM (Catalogue number: XPB70D3A25, Lot number: 231897, Greer Laboratories, Lenoir, N.C., USA) in a volume of 30 ul PBS per nasal.

Preparation and Administration of Positive Control Compound Dexamethasone.

Dexamethasone 21-phosphate disodium salt (Sigma-Aldrich, Catalogue number D1159, Lot N° SLBD.1030V) was solved in $H_2O$ and administered to the animals in a dose of 3 mg/kg in a volume of 200 ul per oral at days indicated in study protocol above.

Terminal Procedure.

On day 14 animals were sacrificed by lethal i.p. injection with pentabarbitol (Streuli Pharma AG, Uznach, Cat: 1170139A) immediately followed by bronchoalveolar lavage (BAL) in 500 ul of saline.

Measurement of Cellular Infiltrates into BAL.

Cells were isolated from the BAL fluid and differential cell counts were performed based upon standard morphological and cytochemical criteria.

Graphs and Statistical Analysis.

All graphs were generated with Graphpad Prism Version 6 and a one-way ANOVA was applied. Results from the statistical analysis were provided with the individual data tables. Error bars represent Standard Error of the Mean (SEM).

Results and Analysis

The results of the experiments are shown in FIGS. 1-9.

No morbidity or mortality was noted in the mice treated with the bacteria or the vehicle. The two controls, vehicle treatment (negative control) and the dexamethasone treatment (positive control) behaved as expected, with impaired eosinophilia and neutrophilia noted following dexamethasone treatment.

Figure 6:
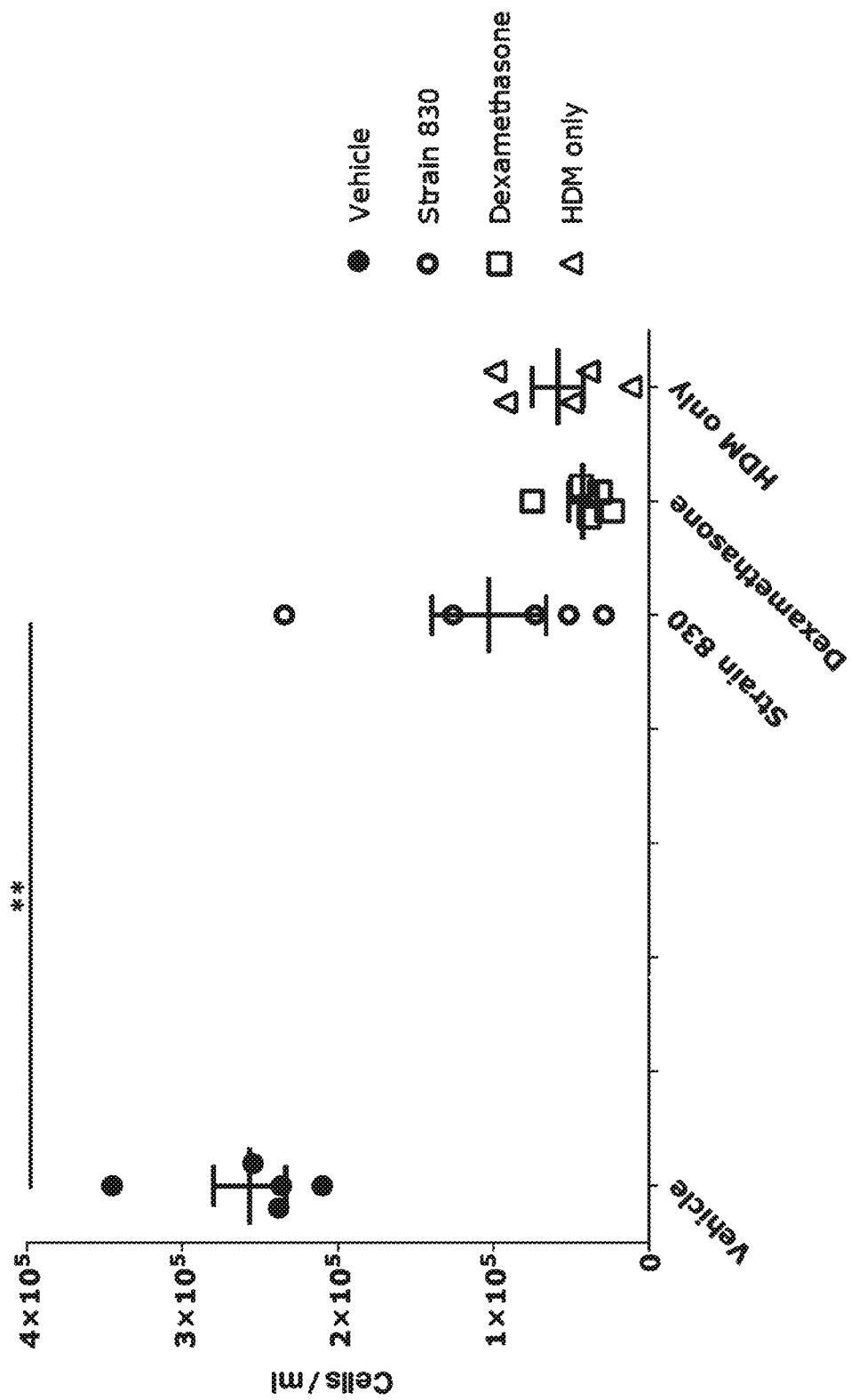
FIG. 6: Mouse model of house dust mite-induced asthma—Total neutrophil count in BALF.
Figure 7:
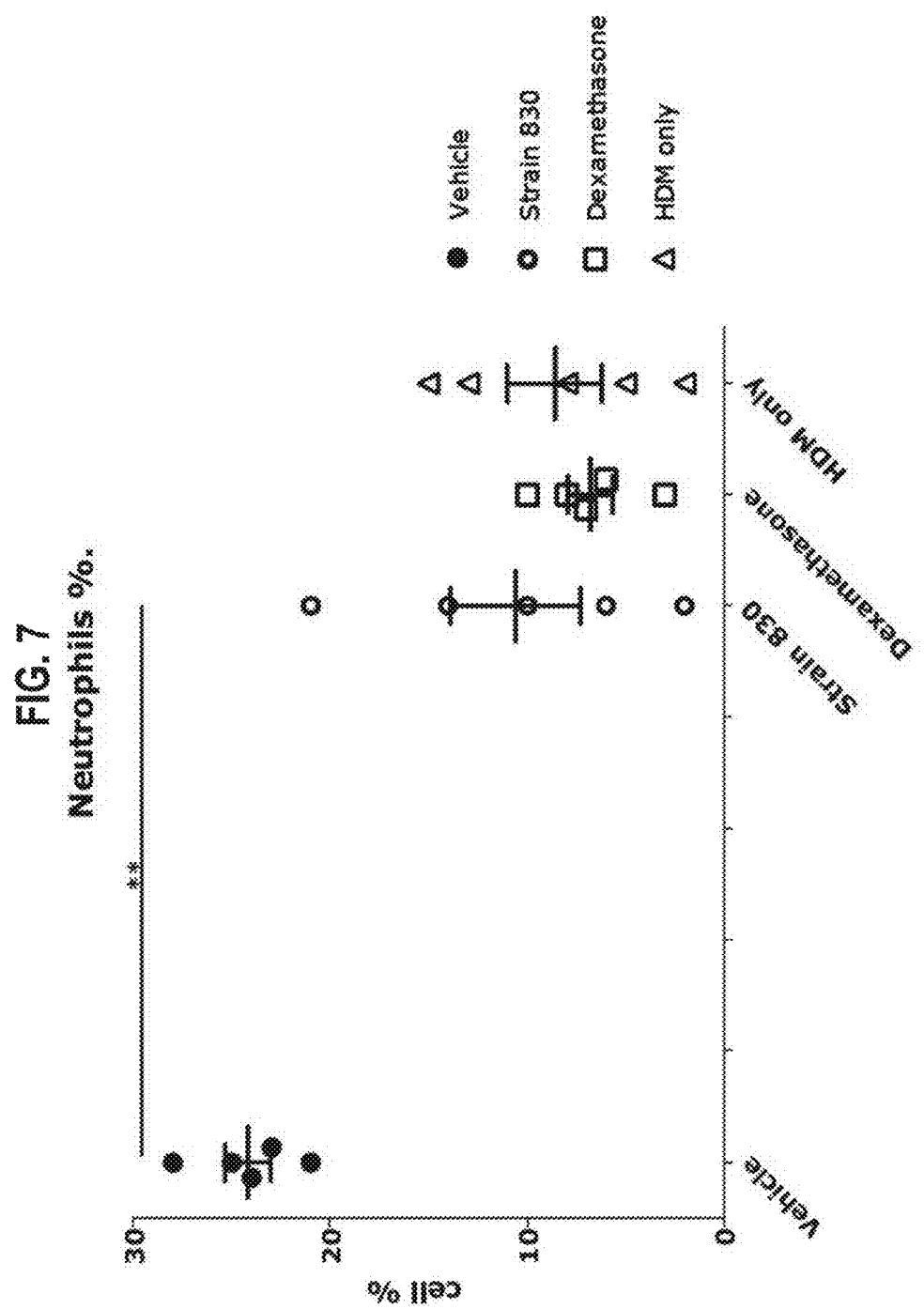
FIG. 7: Mouse model of house dust mite-induced asthma—Proportion of neutrophils in BALF.
Figure 8:
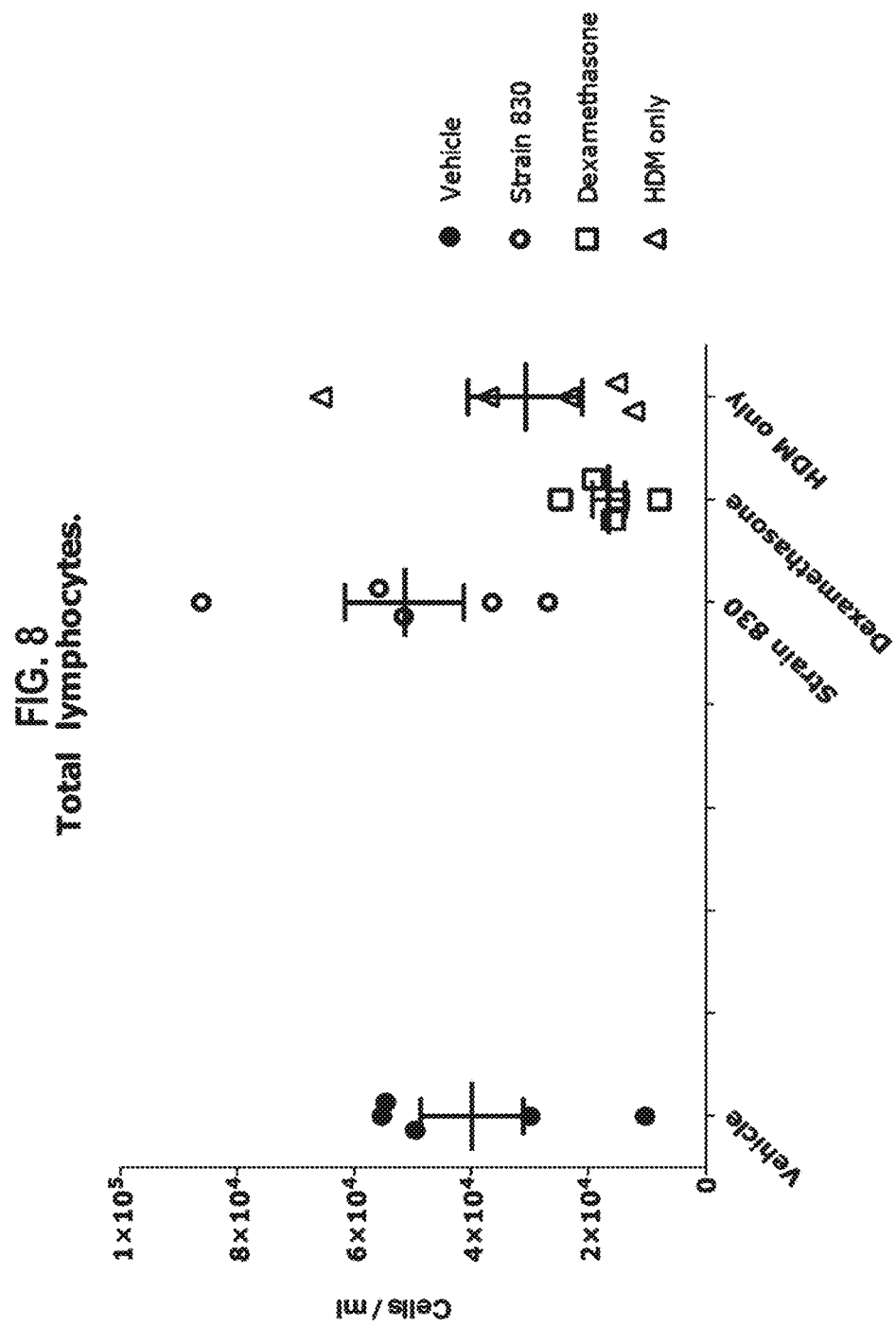
FIG. 8: Mouse model of house dust mite-induced asthma—Total lymphocyte count in BALF.
Figure 9:
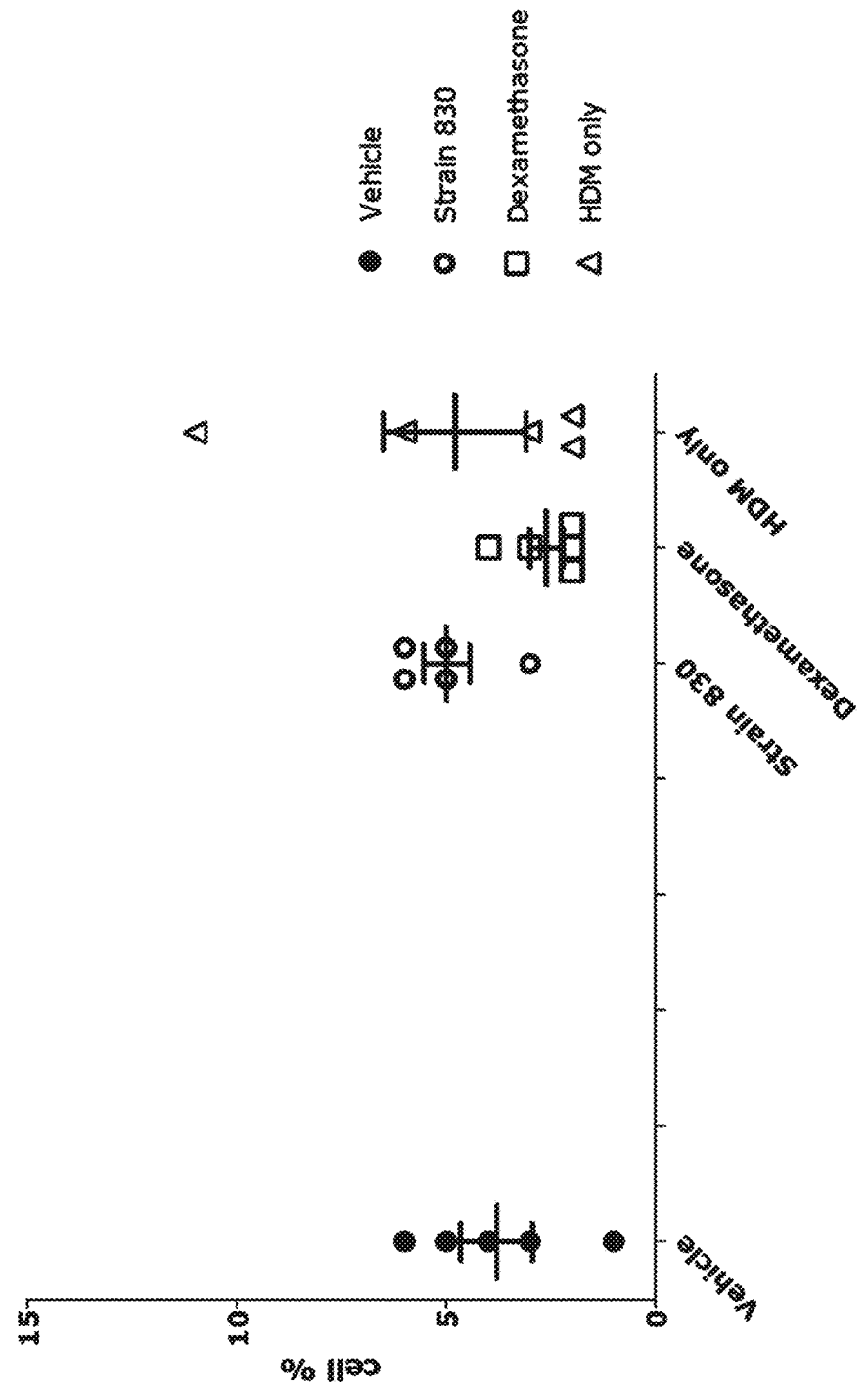
FIG. 9: Mouse model of house dust mite-induced asthma—Proportion of lymphocytes in BALF.
Figure 10:
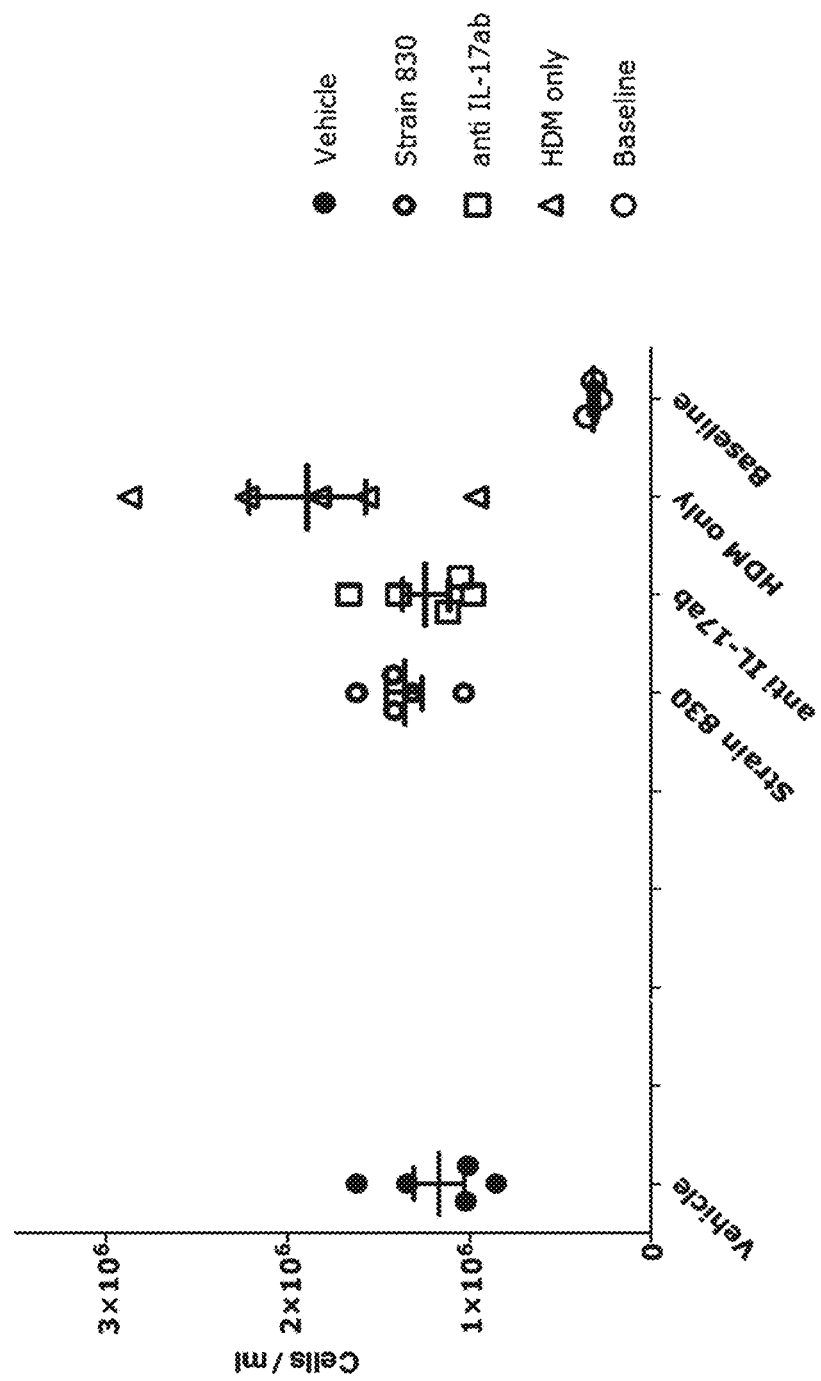
FIG. 10: Mouse model of severe neutrophilic asthma—Total BAL fluid cell counts.
Figure 11:
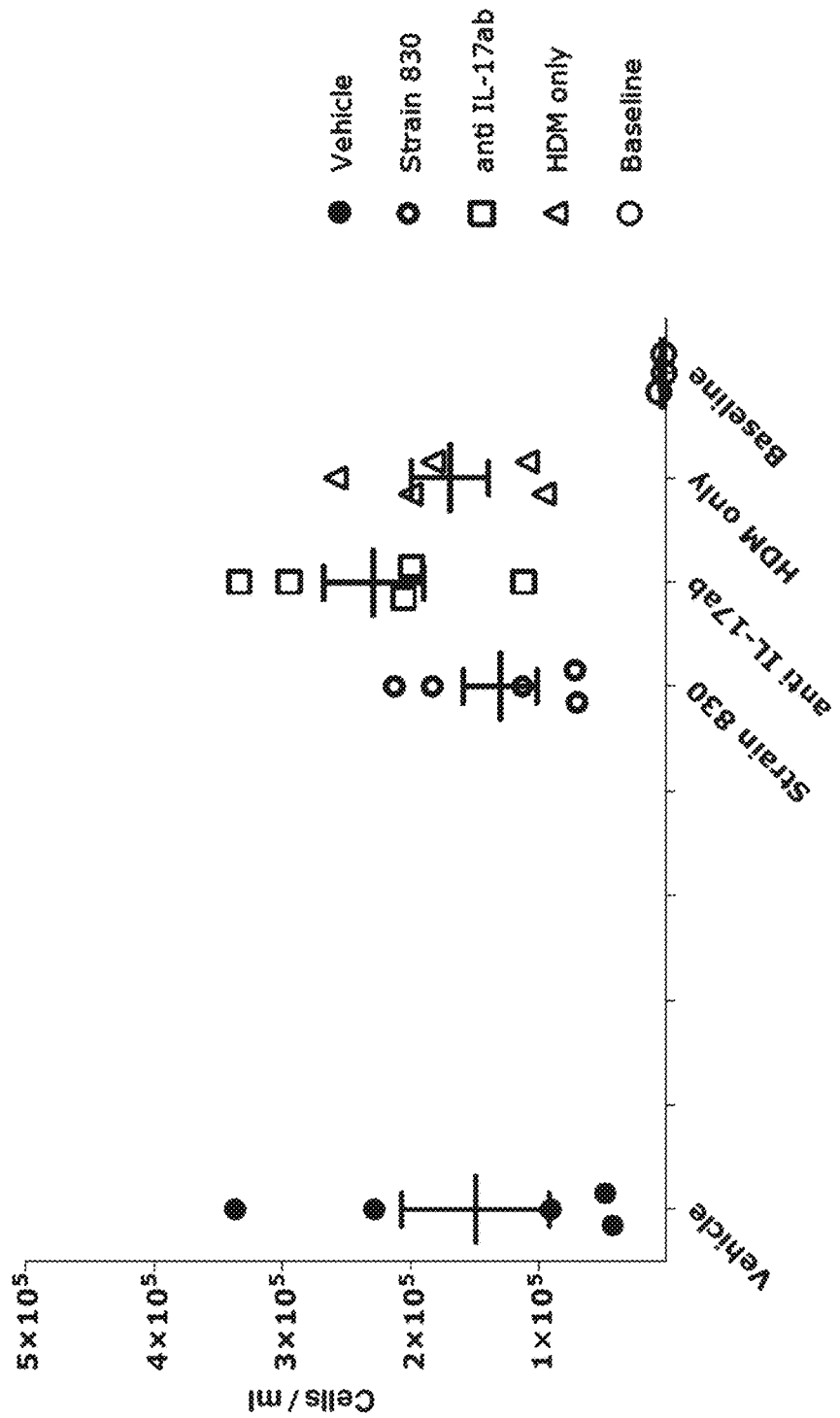
FIG. 11: Mouse model of severe neutrophilic asthma—Total eosinophil count in BALF.
Figure 12:
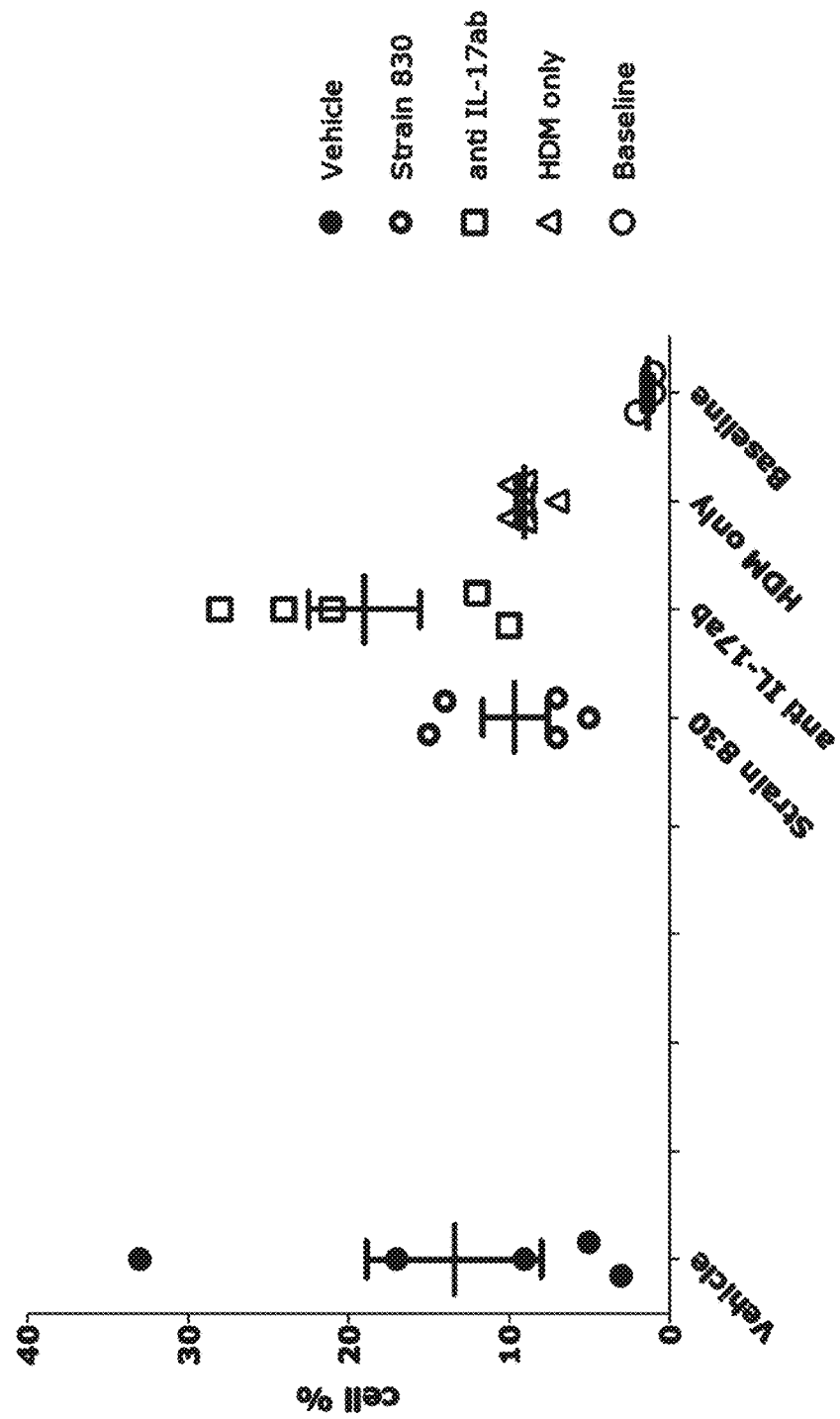
FIG. 12: Mouse model of severe neutrophilic asthma—Proportion of eosinophils in BALF.
Figure 13:
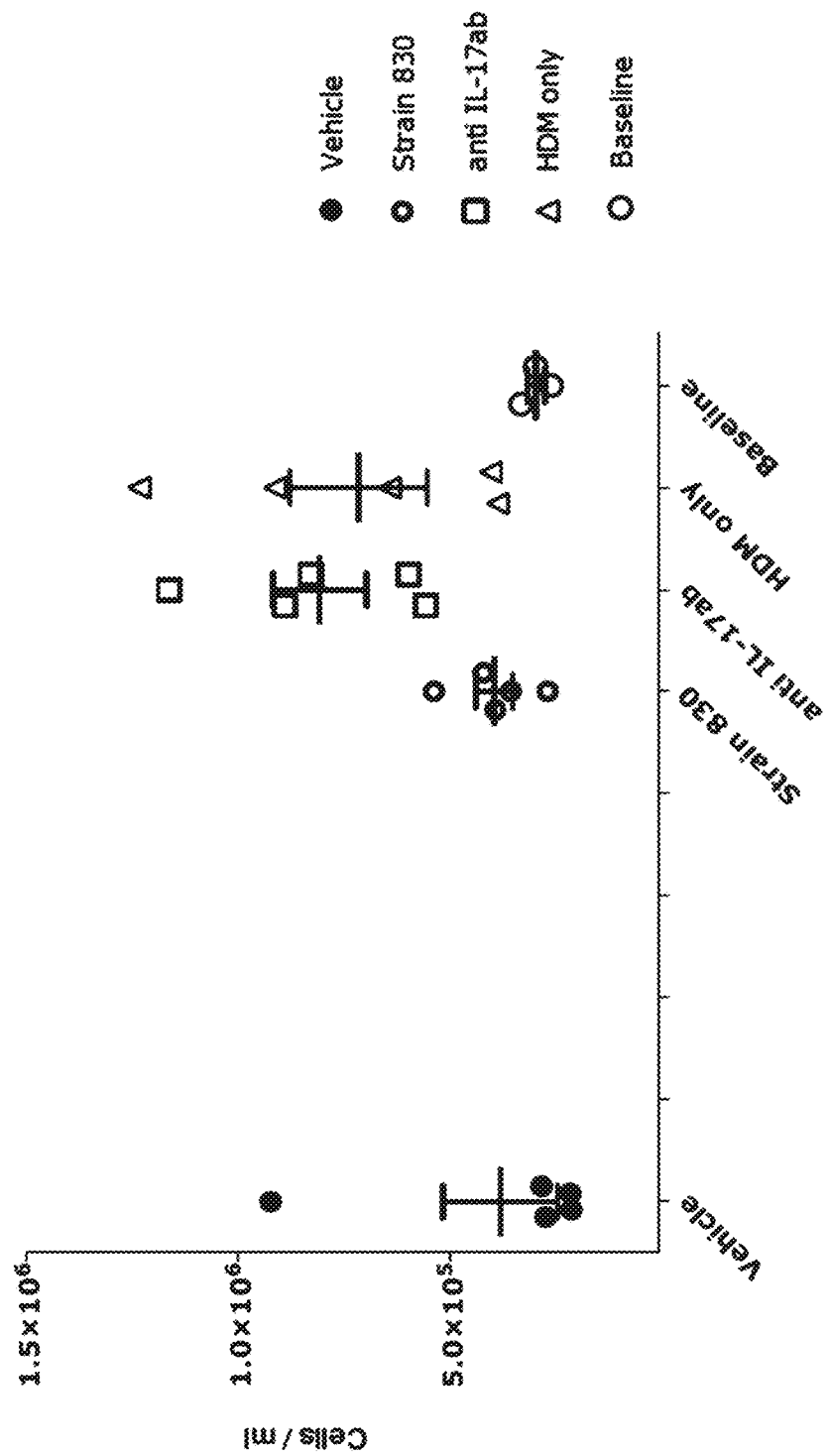
FIG. 13: Mouse model of severe neutrophilic asthma—Total macrophage count in BALF.
Figure 14:
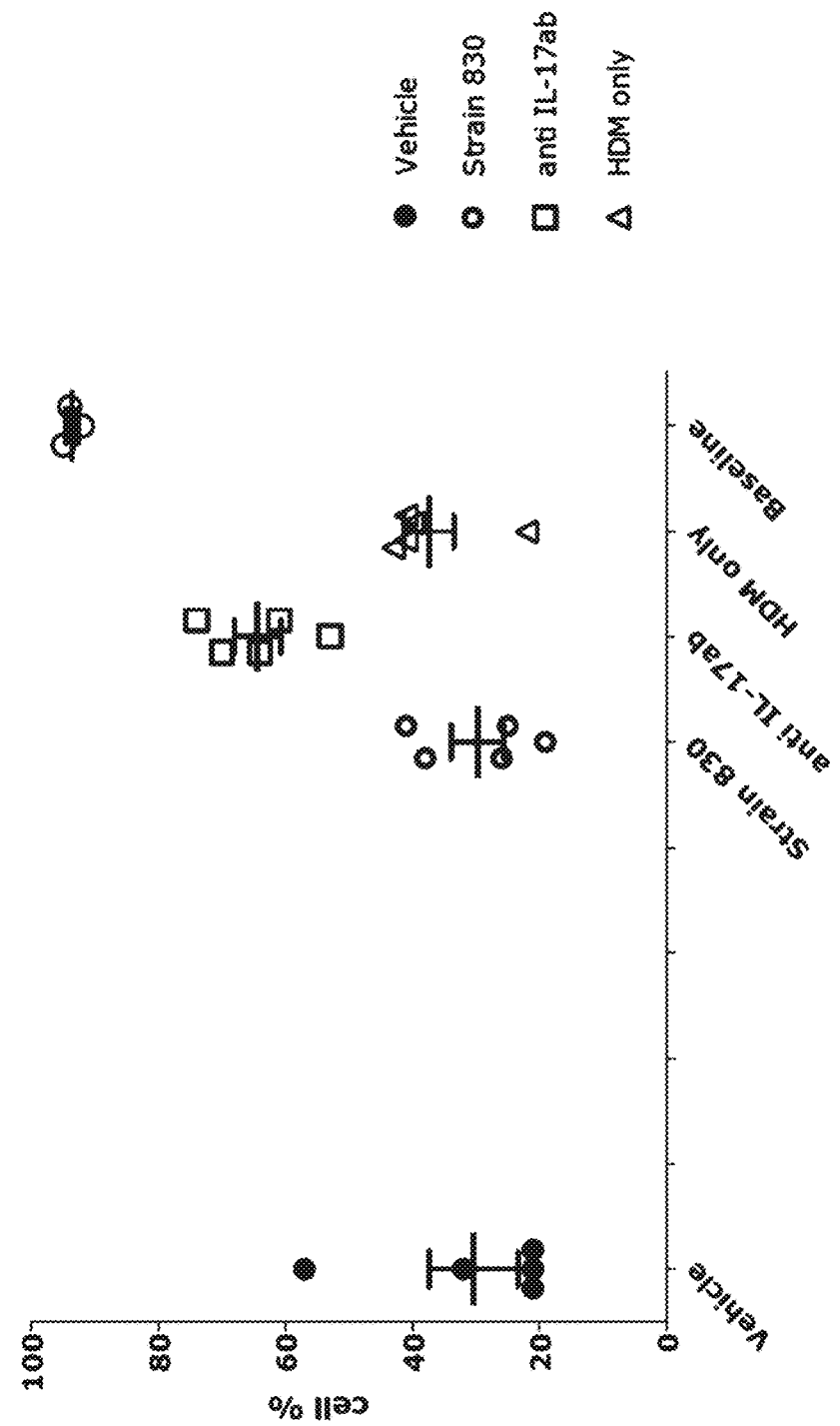
FIG. 14: Mouse model of severe neutrophilic asthma—Proportion of macrophages in BALF.
Figure 15:
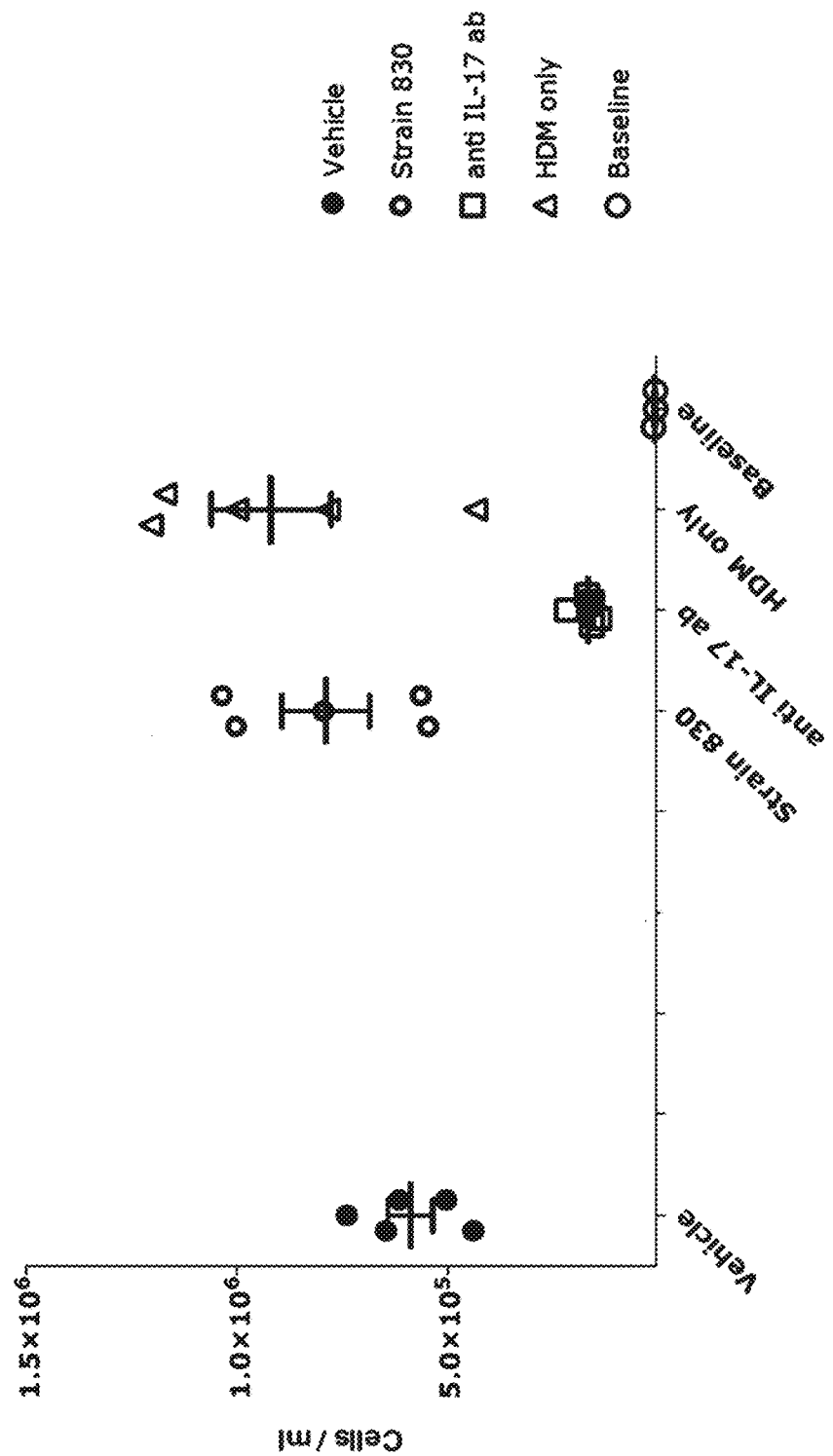
FIG. 15: Mouse model of severe neutrophilic asthma—Total neutrophil count in BALF.
Figure 16:
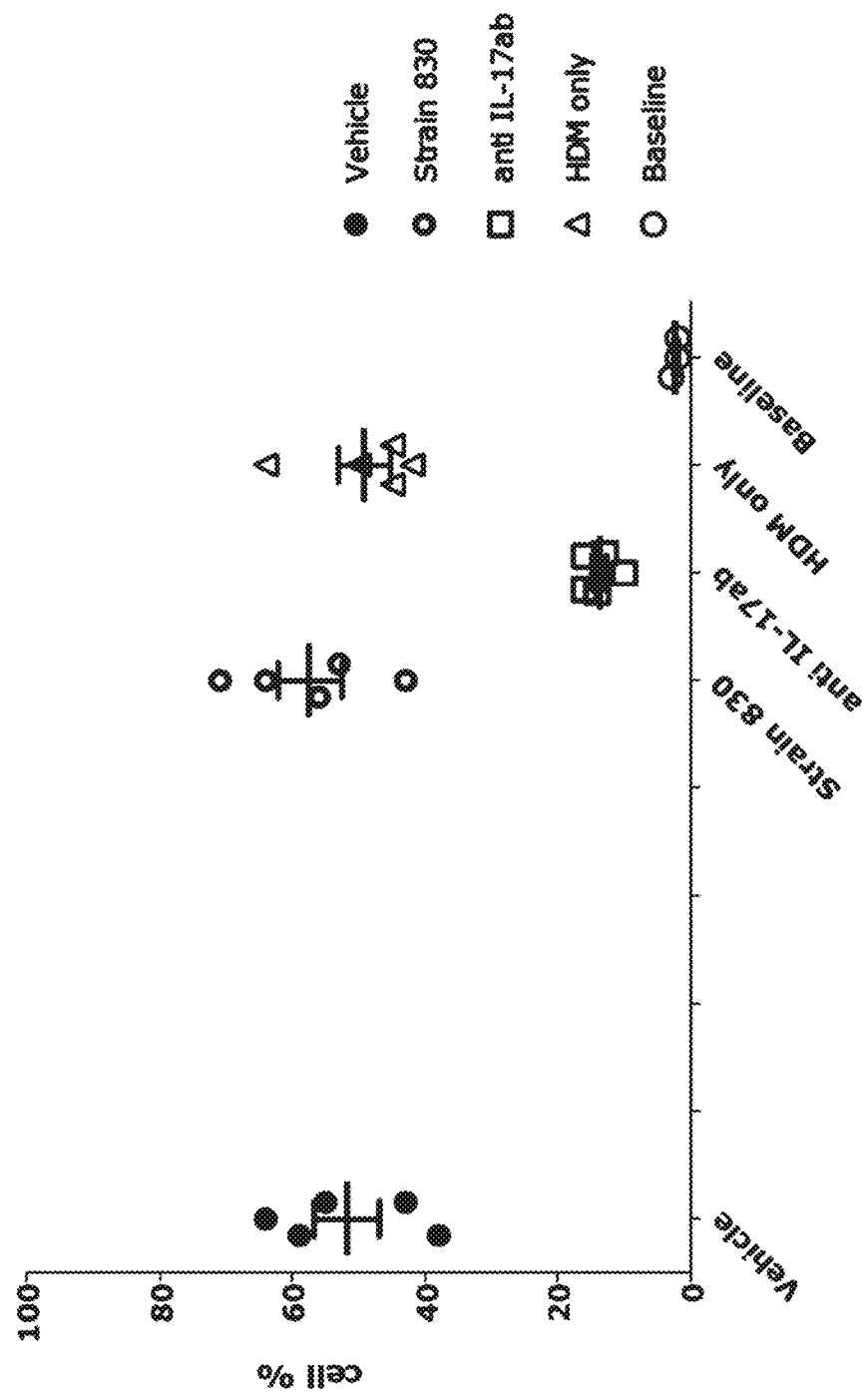
FIG. 16: Mouse model of severe neutrophilic asthma—Proportion of neutrophils in BALF.
Figure 17:
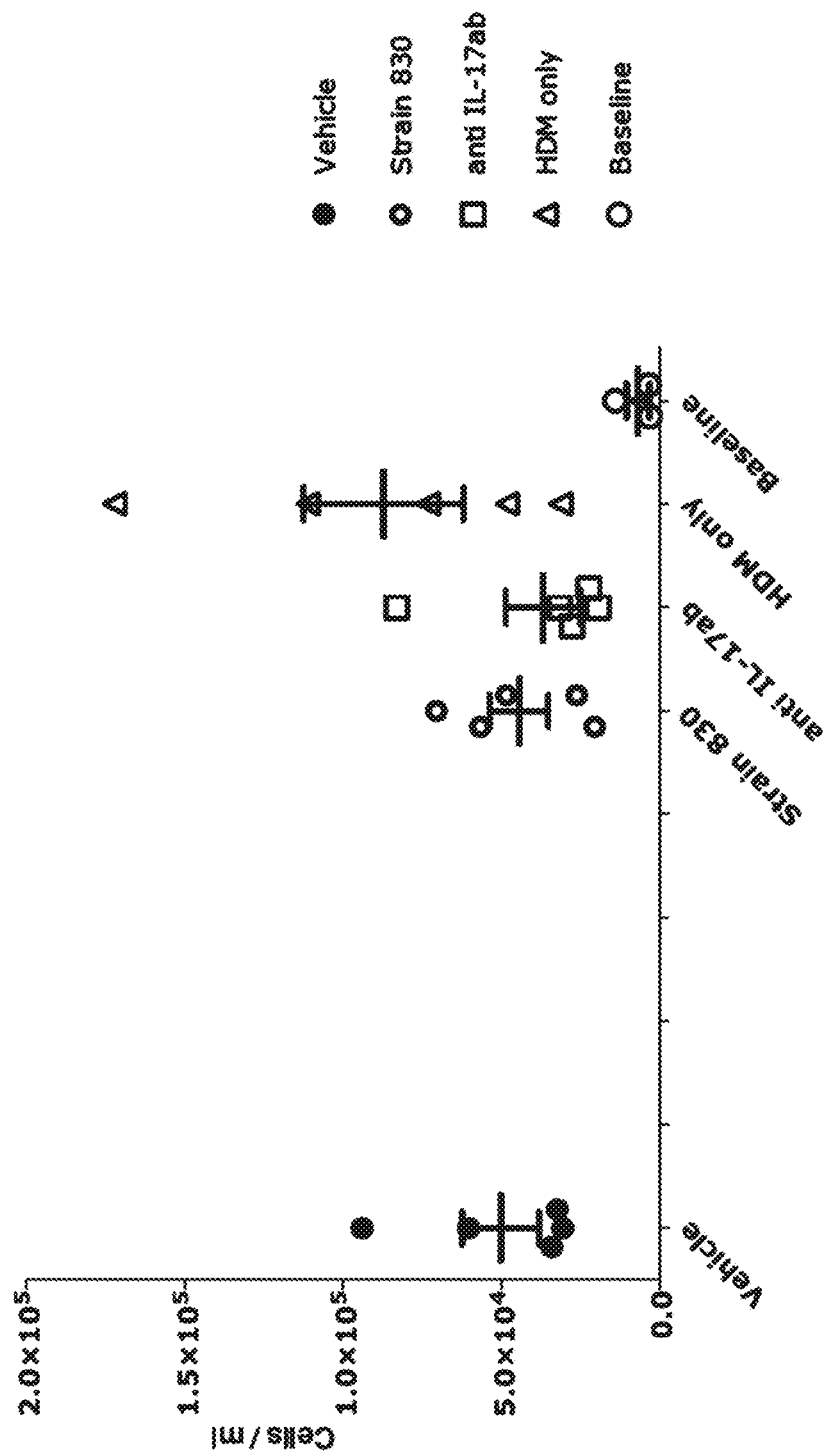
FIG. 17: Mouse model of severe neutrophilic asthma—Total lymphocyte count in BALF.
Figure 18:
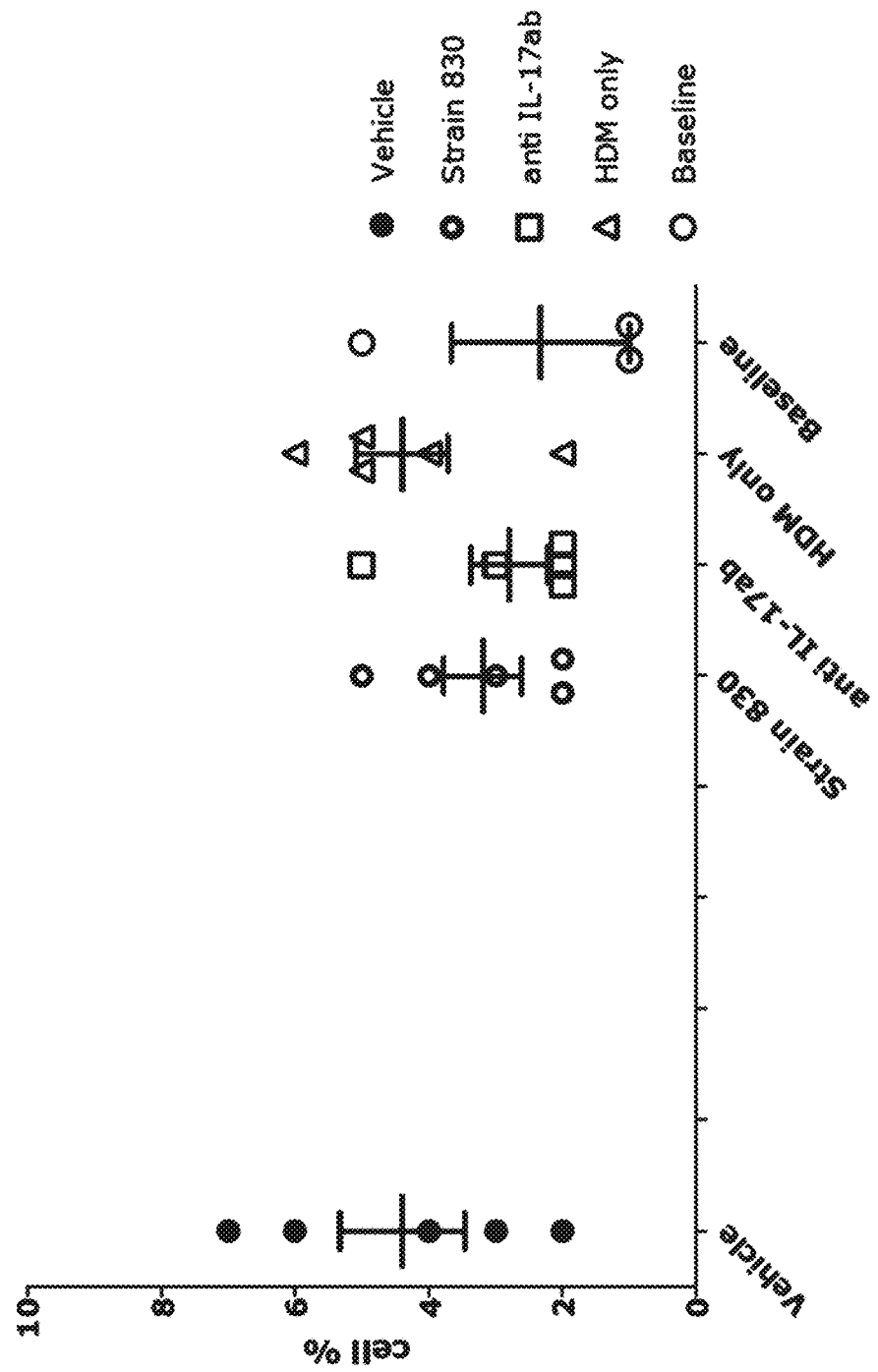
FIG. 18: Mouse model of severe neutrophilic asthma—Proportion of lymphocytes in BALF.

The most important results of this experiment are displayed in FIGS. 6 and 7, which report on the total number and percentage of neutrophils detected in bronchiolar lavage following challenge with HDM. Administration of strain 830 resulted in a reduction in total neutrophils and the proportion of neutrophils in BAL relative to the vehicle-only control.

Example 2—Efficacy of Bacterial Inocula in a Mouse Model of Severe Neutrophilic Asthma Summary Mice were administered with compositions comprising bacterial strains according to the invention and were subsequently sensitised with subcutaneous administrations of house dust mite (HDM) extract and challenged with an intranasal administration of HDM in order to model the inflammatory response of severe neutrophilic asthma. The magnitude and characteristics of the inflammatory response exhibited by mice treated with compositions of the invention were compared to control groups. The compositions of the invention were found to alleviate the inflammatory response, and in particular to reduce recruitment of neutrophils, in a manner comparable to the positive control comprising administrations of anti-IL-17 antibodies. The data therefore indicate that the compositions of the invention may be useful for treating IL-17- and Th17-mediated conditions such as neutrophilia and asthma.

Strain

830: *Blautia* stercoris

Study Design

Groups:

1. Negative control group. Treatment with vehicle control (per oral).
6. Treatment with therapeutic bacteria inoculum strain 830 (per oral).
7. Positive control group. Treatment anti-IL-17 (i.p.).
8. Untreated Control Group.
9: Healthy mice (baseline).

Number of mice per group (Group 1-8)=5

Day −14 to day 17: Daily administration of vehicle control per oral (Group 1).

Day −14 to day 17: Daily administration of therapeutic bacteria inoculum per oral (Group 2-6).

Day 0: Sensitization with HDM in CFA (s.c.) (Group 1-8).

Day 7: Sensitization with HDM in CFA (s.c.) (Group 1-8).

Day 13, 15, 17: Administration of anti IL-17 neutralizing antibody per i.p. (Group 7).

Day 14, 15, 16, 17: Challenge with HDM in 30 ul PBS per nasal (Group 1-8).

Day 18: Sacrifice of all animals for analysis.

Endpoints and Analysis:

On day 14 animals were sacrificed by lethal intraperitoneal injection with pentabarbitol (Streuli Pharma AG, Uznach, Cat: 1170139A) immediately followed by a bronchoalveolar lavage (BAL). Cells were isolated from the BAL fluid and differential cell counts performed (200 cell counts/samples).

Material and Methods.

Mice.

Female 7 week old C57BL/6 mice were purchased from Charles River Laboratories and randomly allocated to cages totally 5 mice per cage (Ventilated cages sourced from Indulab AG, Gams, Switzerland Cage type: "The Sealsafe™—IVC cage. Product number 1248L). Cages were labelled with study number, group number and experimental starting date. Mice were monitored weekly and acclimatized to facility for 7 days prior to initiation of study (Study Day −14). Animals were 8 weeks old on Study Day −14. Potable water and food were available ad libitum. Cage enrichment was present. Daily care of the animals was performed according to local authorization license number 2283.1 (issued and approved by: Service de la consommation et des affaires vétérinaires du Canton de Vaud). Potable water and food were available ad libitum and refreshed once daily. Cage enrichment was present. Animal welfare regulations were observed as given by official authorities of Switzerland under ordinance 455.163 of the FVO (Federal Veterinary Office) on laboratory animal husbandry, production of genetically modified animals, and methods of animal experimentation.

Culturing of Bacteria Inoculum.

Within a sterile workstation, a cryo-vial of bacteria was thawed by warming in gloved hand and ~0.7 ml of contents injected into a Hungate tube (Cat Number, 1020471, Glasgerätebau Ochs, Bovenden-Lenglern, Germany), containing 8 ml of anaerobic YCFA. Two tubes per strain were usually prepared. The Hungate tubes were then incubated (static) at 37° C. for up to 24-26 hours (for strain 830).

Culturing of Vehicle Control.

A Hungate tube containing 8 ml of anaerobic YCFA was incubated (static) at 37° C. for 16 h.

Administration of Bacteria Inoculum or Vehicle Control.

400 ul of cultured bacteria inoculum or vehicle control were administered per day per oral gavage.

HDM Sensitization.

50 µg of HDM (Catalogue number: XPB70D3A25, Lot number: 231897, Greer Laboratories, Lenoir, N.C., USA) in PBS was emulsified in equal volume of complete Freund's adjuvant (CFA Chondrex Inc. Washington, USA) and administered subcutaneously in a volume of 200 twice over two weeks on opposite flanks. A week after the second immunization, mice were anesthetized by i.p. injection with 9.75 mg xylasol and 48.75 mg ketasol per kg (Dr. E. Graeub AG, Bern, Switzerland) and then given intranasal challenges of 15 µg of HDM in a volume of 30 ul PBS on 4 consecutive days. Analysis was performed one day after the final challenge.

Preparation and Administration of Positive Control Compound Anti Mouse IL-17 Antibody.

Anti-IL-17 neutralizing antibody was sourced from Bio X Cell and was stored at 4° C. (Clone 17F3, Cat. Number BE0173, Bio X Cell) and administered per i.p. at a dose of 12.5 mg/kg at days indicated in study protocol above.

Terminal Procedure.

On day 18 animals were sacrificed by lethal i.p. injection with pentabarbitol (Streuli Pharma AG, Uznach, Cat: 1170139A) immediately followed by bronchoalveolar lavage (BAL) in 500 ul of saline.

Measurement of Cellular Infiltrates into BAL.

Cells were isolated from the BAL fluid and differential cell counts were performed based upon standard morphological and cytochemical criteria.

Graphs and Statistical Analysis.

All graphs were generated with Graphpad Prism Version 6 and a one-way ANOVA was applied. Results from the statistical analysis are provided with the individual data tables. Error bars represent Standard Error of the Mean (SEM).

Results and Analysis

The results of the experiment are shown in FIGS. 10-18.

No morbidity or mortality was noted in the mice treated with the bacteria or the vehicle. As shown in FIGS. 11, 12, 15 and 16, certain mice treated with strain 830 exhibited reduced eosinophilia and neutrophilia.

Example 3—Efficacy of Bacterial Inocula to Treat Arthritis in a Type II Collagen-Induced Arthritis Mouse Model Materials and Methods
Strain
830: *Blautia stercoris*
Bacterial Cultures Bacterial cultures were grown up for administration in an anaerobic workstation (Don Whitley Scientific).

Bacterial strain #830 was grown using glycerol stocks. The glycerol stocks were stored at −80° C. Three times per week, glycerol stocks were thawed at room temperature and streaked on YCFA plates. A new glycerol aliquot was used on each occasion. Bacteria were allowed to grow on a given plate for up to 72 hours.

Solutions to be administered to the animals were prepared twice daily with an eight hour interval for morning (AM) and afternoon (PM) treatments. A bacterial colony was picked from the streaked plate and transferred into a tube containing YCFA media. Bacterial strain #830 was allowed to grow for 24 hours before AM administrations. Bacteria were sub-cultured at 1% into YCFA media for PM administrations. OD values were recorded for each strain after morning and afternoon treatment preparations.

Type II Collagen-Induced Arthritis Mouse Model

Adult male DBA/1 mice were randomly allocated to experimental groups and allowed to acclimatise for two weeks. On Day 0, animals were administered by subcutaneous injection with 100 microliters of an emulsion containing 100 micrograms of type II collagen (CII) in incomplete's Freund's adjuvant supplemented with 4 mg/ml *Mycobacterium tuberculosis* H37Ra. On Day 21, animals were administered by subcutaneous injection with a booster emulsion containing 100 µg of type II collagen in incomplete Freund's adjuvant.

Treatments were given according to the administration schedule below. From Day −14 until the end of the experiment on Day 45, animals were weighed three times per week. From Day 21 until the end of the experiment, animals were scored three times per week for clinical signs of arthritis to include swelling of the hind- and front paws, radio-carpal (wrist) joints and tibio-tarsal (ankle) joints.

On Day 45 mice were culled and terminal blood samples were taken for cytokine analysis.

On Day −14, Day 0 and Day 45, faecal samples were collected for microbiological analysis, immediately snap-frozen and stored at −80° C.

The collagen-induced arthritis (CIA) mouse model is a well-established mouse model for rheumatoid arthritis [68]. Immunisation with CII causes a pathogenesis that includes several important pathological features of rheumatoid arthritis, including synovial hyperplasia, mononuclear cell infiltration and cartilage degradation. Significantly, the development of CIA is mediated by Th17 cells through secretion of IL-17A [69]. The immune response underlying the arthritis model is enhanced by the use of Freund's adjuvant supplemented with *Mycobacterium tuberculosis*.

On Day 21, spleens were collected from three satellite animals in each group. Cells were cultured for 72 hours in the presence or absence of type II collagen. Cytokines, including TNF-α, IL-6, IFN-γ, IL-4, IL-10 and IL-17, were quantified in the culture supernatants and in terminal serum by Luminex. Cell proliferation was quantified using a tritiated thymidine incorporation method.

Treatment Groups and Dosages

All Groups were n=15 (n=12 for the main study group and n=3 for satellite groups)

The vehicle used for the biotherapeutics was Yeast extract-Casitone-Fatty Acids (YCFA) medium.

| Group | Dose | Administration Route | Regimen | Disease Induction |
|---|---|---|---|---|
| 1 Vehicle | 5 ml/kg | PO | BID: Day-14-End | Day 0: Collagen/CFA, once, SC Day 21: Collagen/IFA, once, SC |
| 3 Biotherapeutic #830 | 5 ml/kg | | | |

PO: oral gavage,
SC: subcutaneous injection,
BID: twice a day,
CFA: complete Freund's adjuvant.

Bodyweights

From Day −14 until the end of the experiment, animals were weighed three times per week. Data were graphed (Mean±SEM).

Non-Specific Clinical Observations

From Day −14 until the end of the experiment, animals were checked daily for non-specific clinical signs to include abnormal posture (hunched), abnormal coat condition (pilo-erection) and abnormal activity levels (reduced or increased activity).

Clinical Observations

From Day 21 until the end of the experiment on Day 45, animals were scored three times per week for clinical signs of arthritis to include swelling of the hind- and front paws, radio-carpal (wrist) joints and tibio-tarsal (ankle) joints. Each limb was scored using the following scale: (0) normal, (1) slight swelling, (2) mild swelling, (3) moderate swelling and (4) severe swelling. A clinical score was calculated by adding each limb score. The maximum possible clinical score for an animal was (16). Animals with a score equal to (12) on two consecutive occasions and animals with a score greater than (12) on any one occasion were culled. Data were graphed (Mean±SEM).

Cell Proliferation Analysis

On Day 21, three satellite animals per group were culled and spleens were dissected out. Spleen cells were cultured for 72 hours in presence or absence of type II Collagen. After 72 hours, cells were pulsed overnight in the presence of tritiated thymidine. Cell proliferation was quantified by measuring thymidine incorporation. Data were graphed (Mean±SEM). Supernatants were taken and tested for the presence of key cytokines.

Cytokine Analysis

Terminal supernatants from the spleen cell cultures were tested in order to quantitate TNF-α, IL-6, IFN-γ, IL-4, IL-10 and IL-17 by Luminex. Data were graphed (Mean±SEM).

Microbiological Analysis

On Day −14, Day 0 and Day 45, faecal samples were collected from each animal, immediately snap-frozen, and stored at −80° C. Caeca (including content) were immediately snap-frozen and stored at −80° C. A bacterial identification test was performed daily by plating the bacteria.

Histopathology

At the end of the experiment, hind paws were stored in tissue fixative. Samples were transferred into decalcification solution. Tissue samples were processed, sectioned and stained with Haematoxylin & Eosin. Sections were scored by a qualified histopathologist, blind to the experimental design, for signs of arthritis to include inflammation, articular cartilage damage and damage to the underlying metaphyseal bone. A detailed scoring system was used (see below). Data were graphed (Mean±SEM). Raw and analysed data were provided as well as representative pictures.

TABLE 1

| Histopathology Scoring System | |
|---|---|
| Grade | Description |
| Inflammation | |
| 0 | Normal joint |
| 1 | Mild synovial hyperplasia with inflammation dominated by neutrophils. Low numbers of neutrophils and macrophages in joint space. |
| 2 | Synovial hyperplasia with moderate to marked inflammation involving both neutrophils and macrophages. Neutrophils and macrophages in joint space; may be some necrotic tissue debris. |
| 3 | Synovial hyperplasia with marked inflammation involving both neutrophils and macrophages. Loss of synoviocyte lining. Inflammation may extend from synovium to surrounding tissue including muscle. Numerous neutrophils and macrophages in joint space, together with significant necrotic tissue debris. |
| Articular cartilage damage | |
| 0 | Normal joint |
| 1 | Articular cartilage shows only mild degenerative change. Early pannus formation may be present peripherally. |
| 2 | Articular cartilage shows moderate degenerative change and focal loss. Pannus formation is present focally. |
| 3 | Significant disruption and loss of articular cartilage with extensive pannus formation. |
| Damage to the underlying metaphyseal bone | |
| 0 | Normal joint |
| 1 | No change to underlying metaphyseal bone. |
| 2 | May be focal necrosis or fibrosis of metaphyseal bone. |

TABLE 1-continued

Histopathology Scoring System

| Grade | Description |
|---|---|
| 3 | Disruption or collapse of metaphyseal bone. Extensive inflammation, necrosis or fibrosis extending to medullary space of the metaphysis. |

Results and Analysis
Survival and Non-Specific Clinical Observations

Some animals were culled prior to the scheduled end of the study due to the severity of the clinical signs of arthritis or due to the severity of the non-specific clinical observations.

One animal in Group 1 (vehicle-treated) was culled during the pre-treatment period (Day −14 to Day 0—animal arrived from supplier with broken leg).

Seven animals were culled due to the severity of the clinical signs of arthritis: five animals in Group 1 (vehicle-treated) and two animals in Group 3 (biotherapeutic #830-treated).

Six animals were culled due to the severity of the non-specific clinical signs including abnormal posture (hunched), abnormal coat condition (piloerection), abnormal activity levels (reduced activity): three animals in Group 1 (vehicle-treated) and three animals in Group 3 (biotherapeutic #830-treated).

Bodyweights

Figure 19:
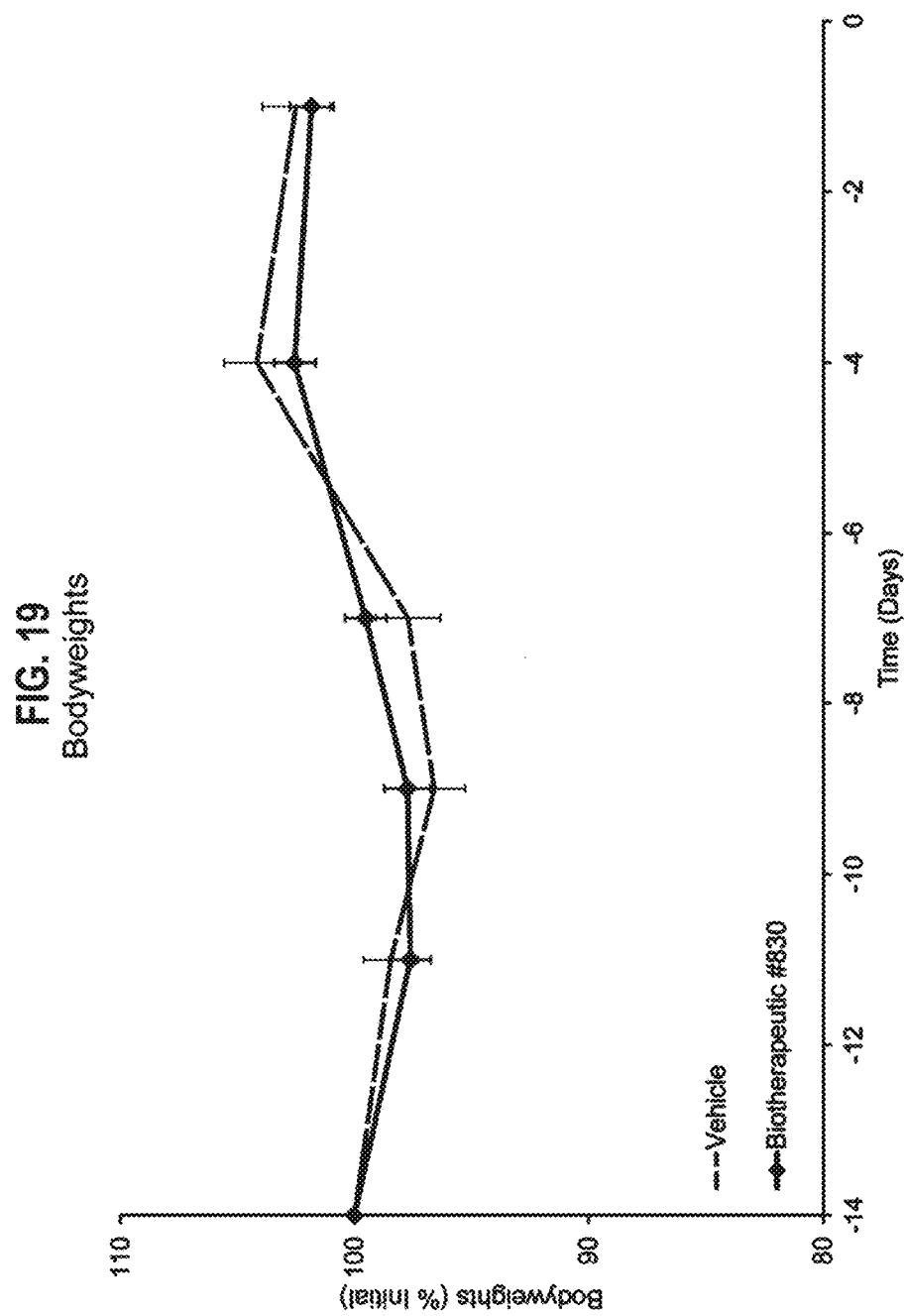
FIG. 19: Mouse model of rheumatoid arthritis—Bodyweights, days −14 to 0. Data are presented as Mean±SEM percentages of the initial (Day −14) bodyweights.

Bodyweight data recorded from Day −14 until Day 0 and expressed as a percentage of the initial (Day −14) bodyweights were analysed by two-way ANOVA followed by Dunnett's post-test for multiple comparisons with Day −14 then for multiple comparison with the vehicle-treated group. The data are presented in FIG. 19. Data from animals culled prior to the scheduled end of the experiment were excluded from the analyses.

When compared to Day −14, twice daily administrations by oral gavage induced a significant bodyweight loss in the vehicle-treated group on Day −9 and Day −7 and in Group 3 (biotherapeutic #830-treated) on Day −11 and Day −9.

Figure 20:
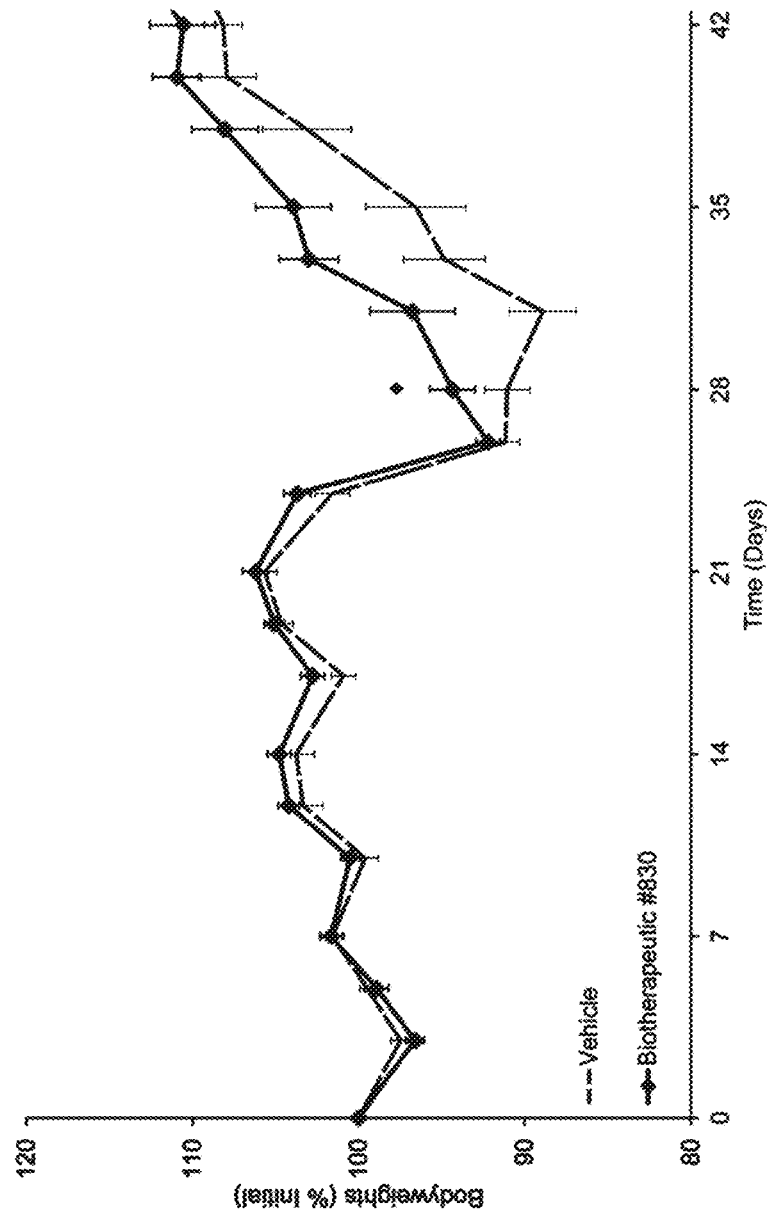
FIG. 20: Mouse model of rheumatoid arthritis—Bodyweights, days 0 to 42. Data are presented as Mean±SEM percentages of the initial (Day 0) bodyweights. ♦ $p<0.05$ when compared to the vehicle-treated group.

Bodyweight data recorded from Day 0 until Day 28 and expressed as a percentage of the initial (Day 0) bodyweights were analysed by two-way ANOVA followed by Dunnett's post-test for multiple comparisons with Day 0 in the Vehicle group then for multiple comparison with the vehicle-treated group. The data are presented in FIG. 20. Data from animals culled prior to the scheduled end of the experiment and from Satellite animals were excluded from the analyses. Day 28, Day 35 and Day 42 data were further analysed by one-way ANOVA followed by Dunnett's post-test for multiple comparisons to the vehicle-treated group.

The onset of clinical signs of arthritis was associated with a significant bodyweight loss on Day 26 and Day 28 ($p<0.0001$) when compared to Day 0 in the vehicle-treated group.

When compared to the vehicle-treated group, the bodyweights were significantly higher in Group 3 (biotherapeutic 4830) treated on Day 28 ($<0.005$).

Clinical Observations

Figure 21:
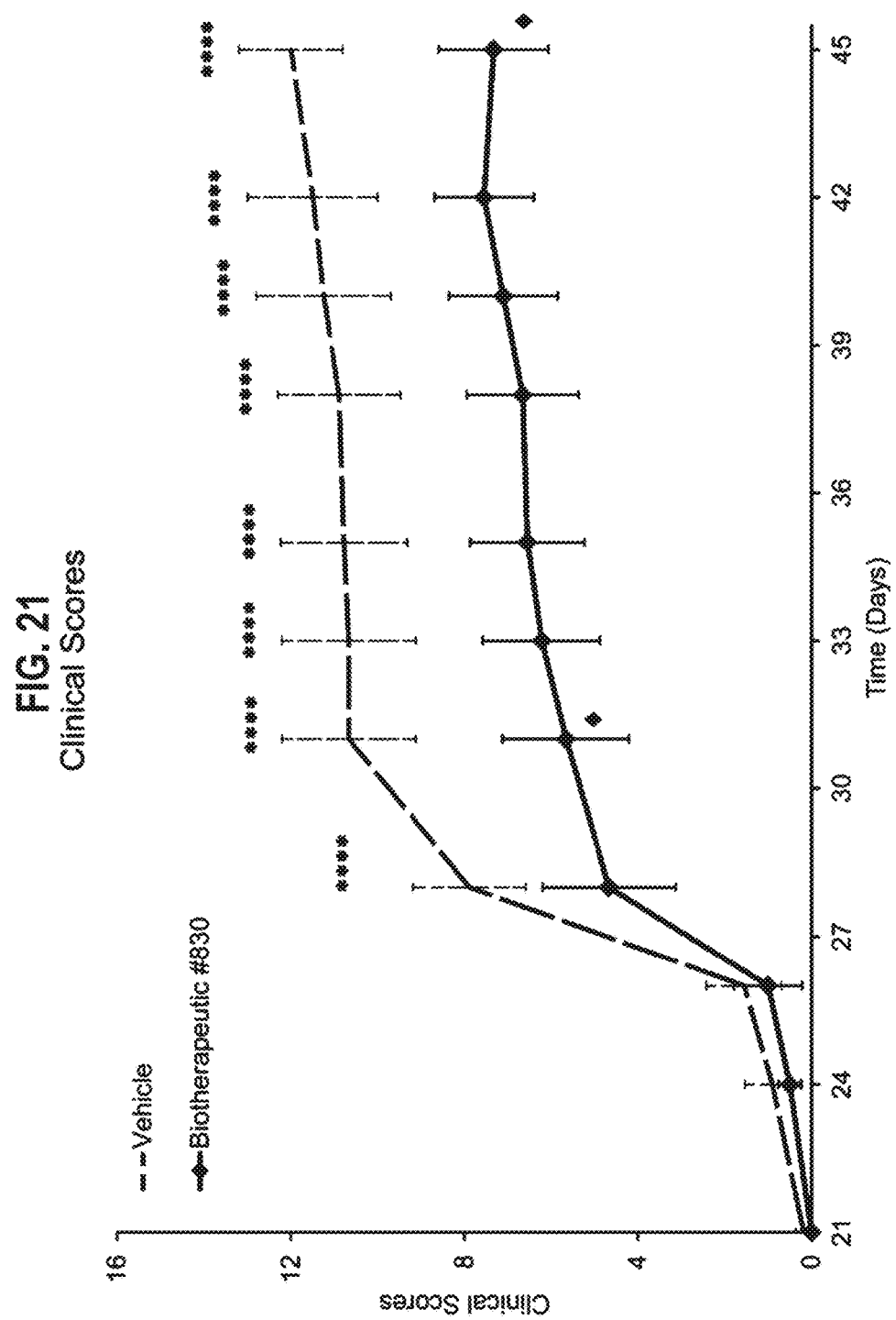
FIG. 21: Mouse model of rheumatoid arthritis—Clinical Scores. Data are presented as Mean±SEM. ****$p<0.0001$ when compared to Day 21 in the vehicle-treated group. ♦ $p<0.05$ when compared to the vehicle-treated group on a given day.

Clinical score data were analysed by two-way ANOVA followed by Dunnett's post-test for multiple comparisons between days in the vehicle-treated group then for multiple comparisons between experimental groups and the vehicle-treated group each day. The data are presented in FIG. 21. Data recorded from animals culled prior to the end of the experiment were excluded from the analysis. When animals were culled due to the severity of the clinical signs of arthritis, the last recorded score was reported for the following days and used in the statistical analyses.

A significant increase of the clinical scores was observed in the vehicle-treated group from Day 28 until Day 45 ($p<0.0001$) when compared to Day 21.

Biotherapeutic #830 induced a reduction of the clinical scores when compared to the vehicle-treated group from Day 28 until Day 45. The reduction was statistically significant on Day 31 and Day 45 ($p<0.05$).

Cell Proliferation Analysis

To validate the assay, splenocytes were cultured in the presence of soluble anti-CD3 and anti-CD28 (anti-CD3/CD28) as positive control stimuli to confirm the proliferative potential of the cells.

Strong proliferative responses to anti-CD3/CD28 were seen in all experimental groups, showing cells were healthy, viable and able to respond to activation signals.

Figure 22:
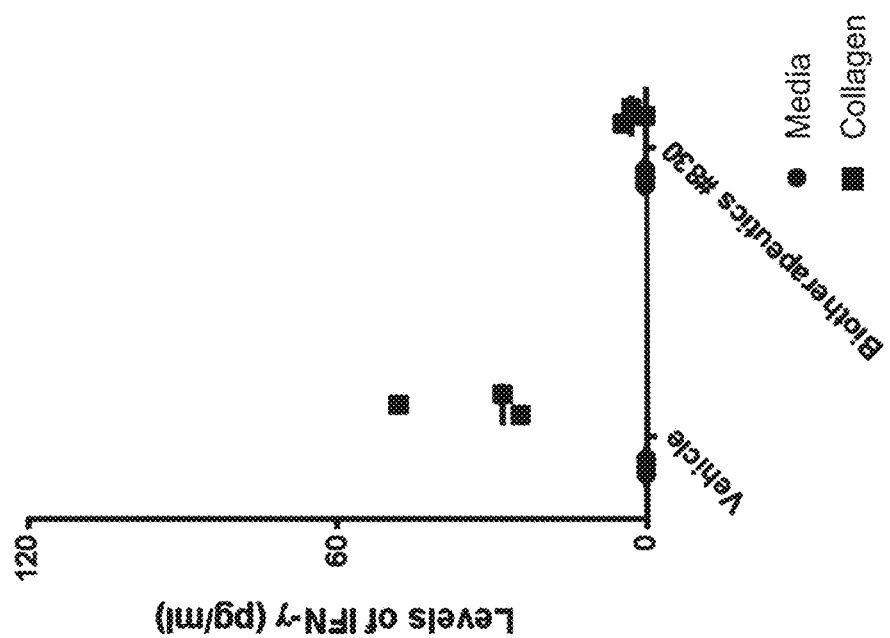
FIG. 22: Mouse model of rheumatoid arthritis—Splenocyte proliferative response to Collagen II. Media background subtracted [CII-stimulated—media background] counts per minute based on 3H-TdR incorporation. All data are presented as Mean±SEM. *$p<0.05$ compared to Vehicle group.

To test the proliferative response in presence of Collagen II (CII), splenocytes were cultured in the presence of CII at 50 µg/ml. Splenocyte proliferative response to CII were analysed by two-way ANOVA followed by Sydak's post-test for multiple comparisons between unstimulated and CII-stimulated splenocytes and one-way ANOVA followed by Dunnett's post-test for comparison of CII-stimulated response in different experimental groups with the vehicle-treated group. The data are presented in FIG. 22.

CII induced a highly significant increase of $^3$H-thymidine incorporation (cpm) when compared to the unstimulated splenocytes in the vehicle-treated group ($p<0.0001$).

The groups treated with biotherapeutic #830 demonstrated significantly lower levels of CII-induced splenocyte proliferation than the vehicle-treated group.

Cytokine Levels in Tissue Culture Supernatants

Levels of each cytokine were measured in tissue culture supernatants derived from anti-CD3/CD28 stimulated cultures by luminex analysis. These showed robust responses for all cytokines measured (mean levels in vehicle group were as follows: IL-4=6,406 pg/ml; IL-6=306 pg/ml; IL-10=10,987 pg/ml; IL-17A=11,447 pg/ml; IFN-γ=15,581 pg/ml; TNF-α=76 pg/ml).

The following sections summarise the data obtained from the Collagen II-stimulated cultures. Where applicable, statistical analyses of the differences between cytokine levels in supernatants of unstimulated and CII-stimulated splenocytes were conducted using two-way ANOVA followed by Sidak's post-test for multiple comparisons, while one-way ANOVA followed by Dunnett's post-test was used for comparison of CII-stimulated response in biotherapeutic-treated groups with the vehicle-treated group. There was no significant difference in cytokine levels between the groups in both cases. This is likely due to the small sample size used (n=3).

In order to more accurately present the distribution of the data for the cytokines with substantial spread of the data, these are presented as scatter plots.

The group means of IL-4 in tissue culture supernatants after stimulation with CII were <5 pg/ml. These are not considered biologically significant and not included here. The group means of TNF-α in tissue culture supernatants after stimulation with collagen were below limit of quantitation.

Figure 23:
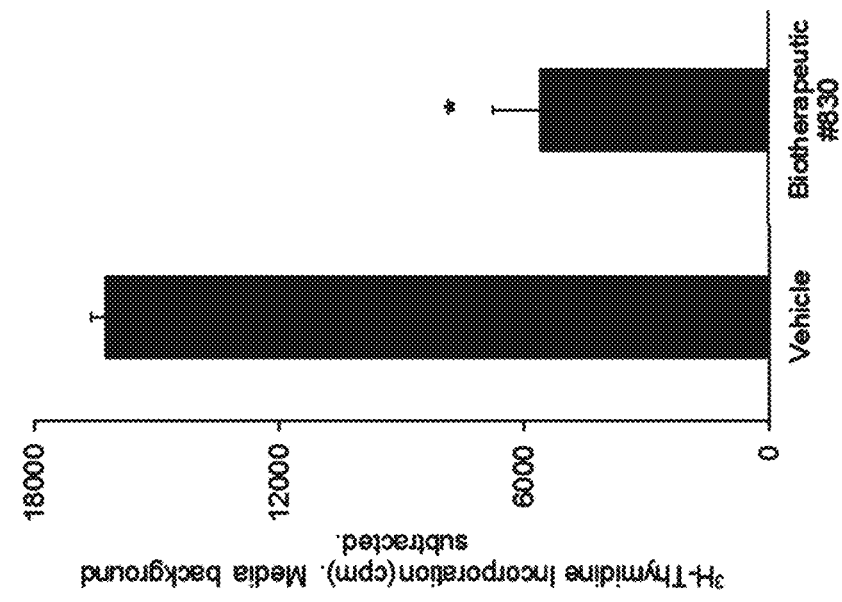
FIG. 23: Mouse model of rheumatoid arthritis—Levels of IFNγ in tissue culture supernatants. Lines represent group median values.

Supernatant Levels of IFN-γ (FIG. 23)

Along with IL-17, IFN-γ is the major cytokine driving disease in the CIA model. The scatter plot in FIG. 23 demonstrates IFN-γ levels after CII stimulation, with group median being higher for the Vehicle-treated group compared to the biotherapeutic.

Figure 24:
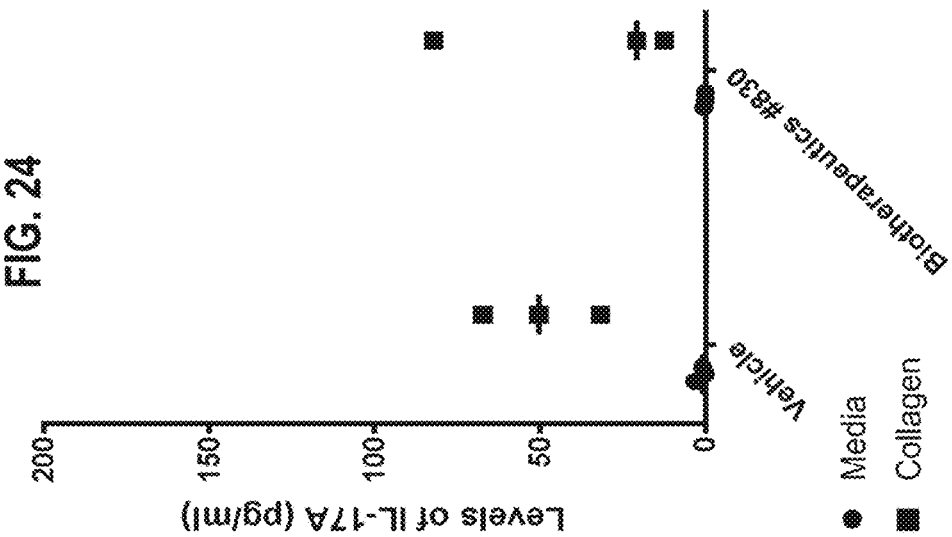
FIG. 24: Mouse model of rheumatoid arthritis—Levels of IL-17A in tissue culture supernatants. Lines represent group median values.

Supernatant Levels of IL-17A (FIG. 24)

Levels of IL-17A were 50 pg/ml in CII-stimulated cultures for the Vehicle-treated group. The levels of this cytokine appeared to be lower in the biotherapeutic group compared to the Vehicle-treated.

Figure 25:
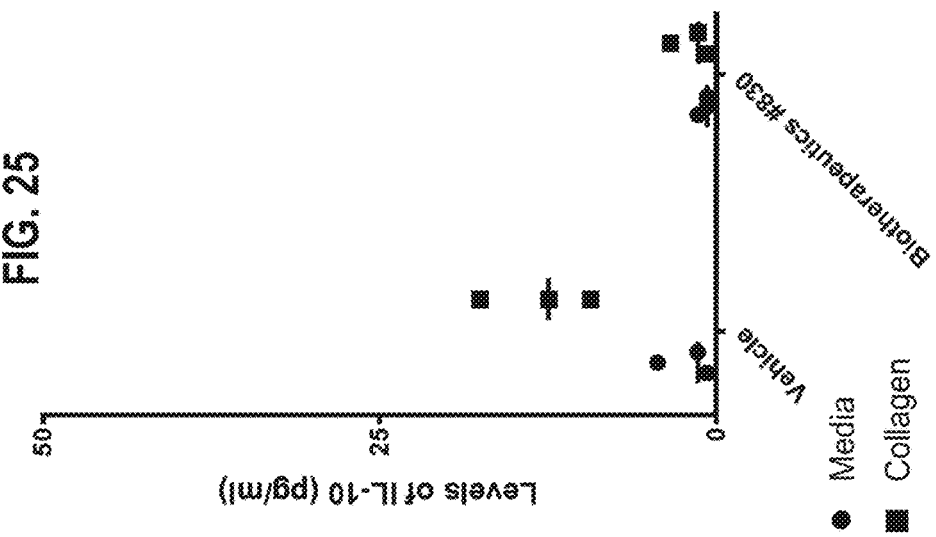
FIG. 25: Mouse model of rheumatoid arthritis—Levels of IL-10 in tissue culture supernatants. Lines represent group median values.

Supernatant Levels of IL-10 (FIG. 25)

Levels of IL-10 in Vehicle-treated group were 13 pg/ml and 2.1 pg/ml for CII-stimulated, and media control cultures, respectively. Higher levels of IL-10 (which is an anti-inflammatory cytokine) for the vehicle-treated group may be expected because inflammation and pro-inflammatory cytokine induction could be accompanied by an anti-inflammatory feedback mechanism.

Figure 26:
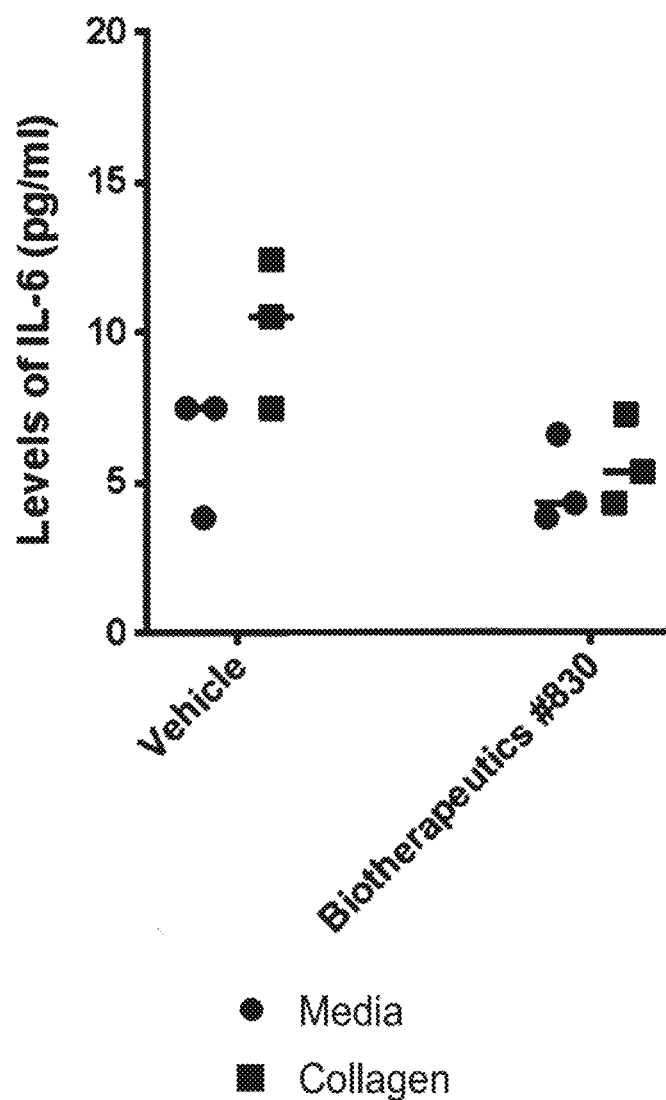
FIG. 26: Mouse model of rheumatoid arthritis—Levels of IL-6 in tissue culture supernatants. Lines represent group median values.
Figure 27:
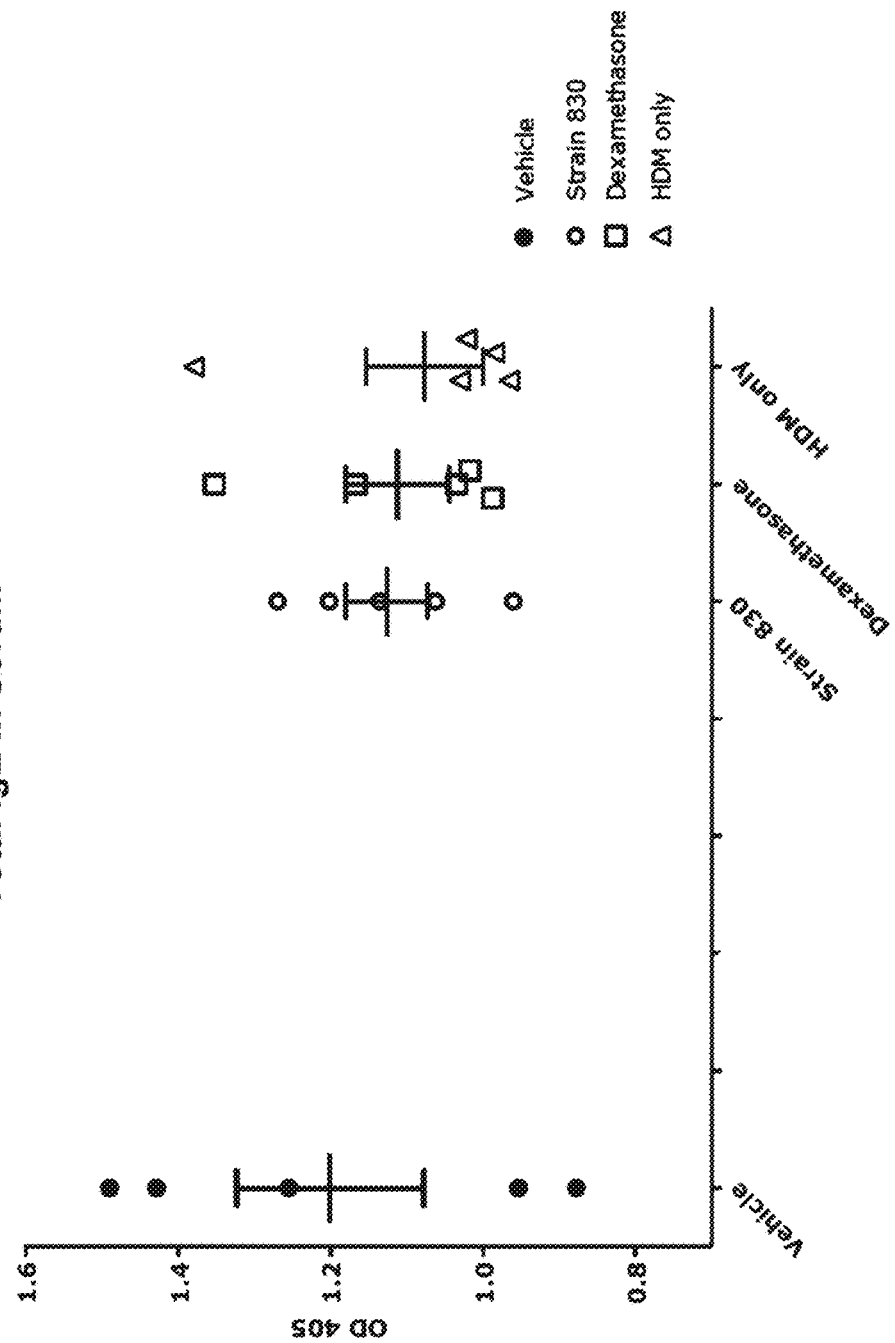
FIG. 27: Mouse model of house dust mite-induced asthma—Total IgE in Serum
Figure 28:
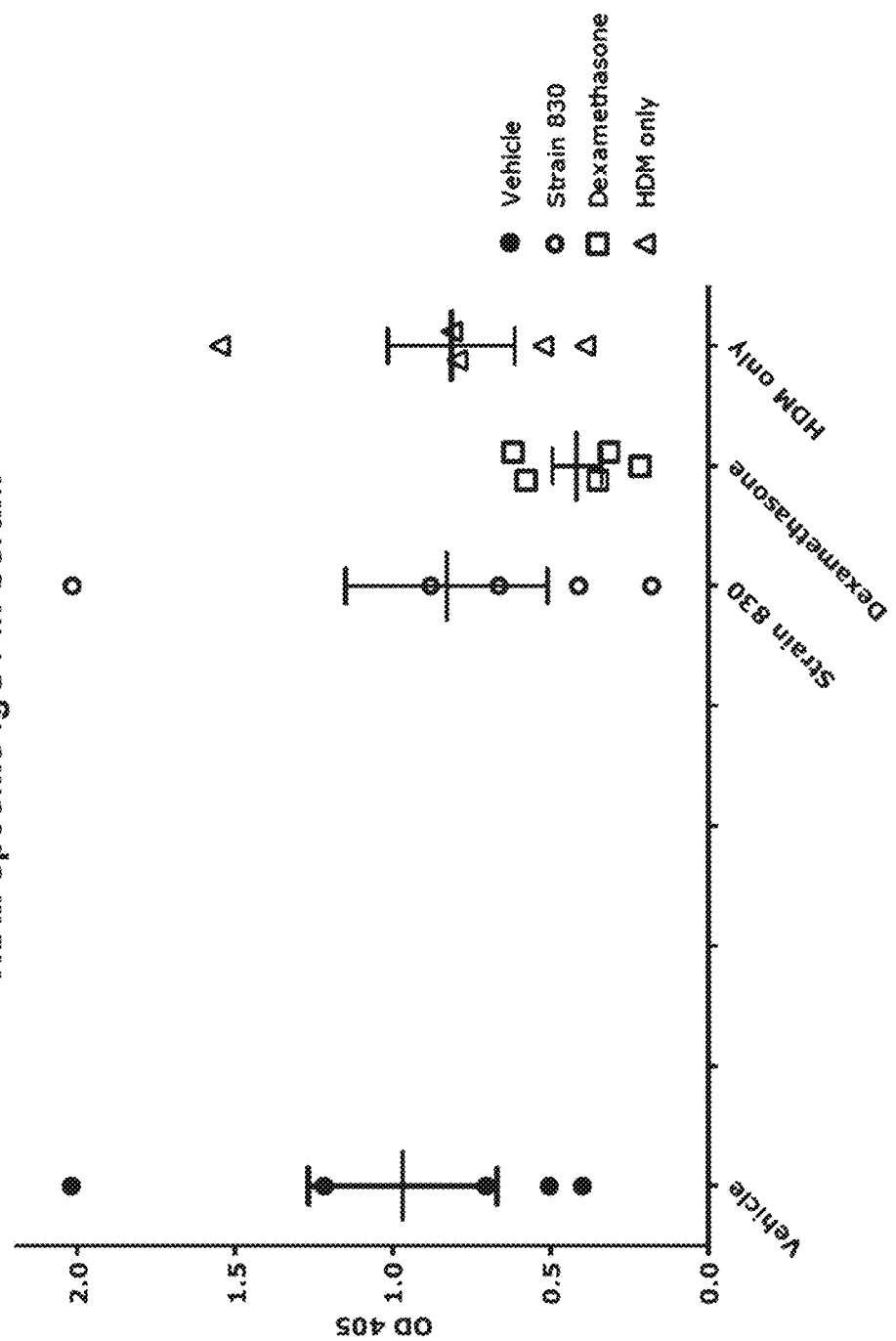
FIG. 28: Mouse model of house dust mite-induced asthma—HDM specific IgG1 in Serum
Figure 29:
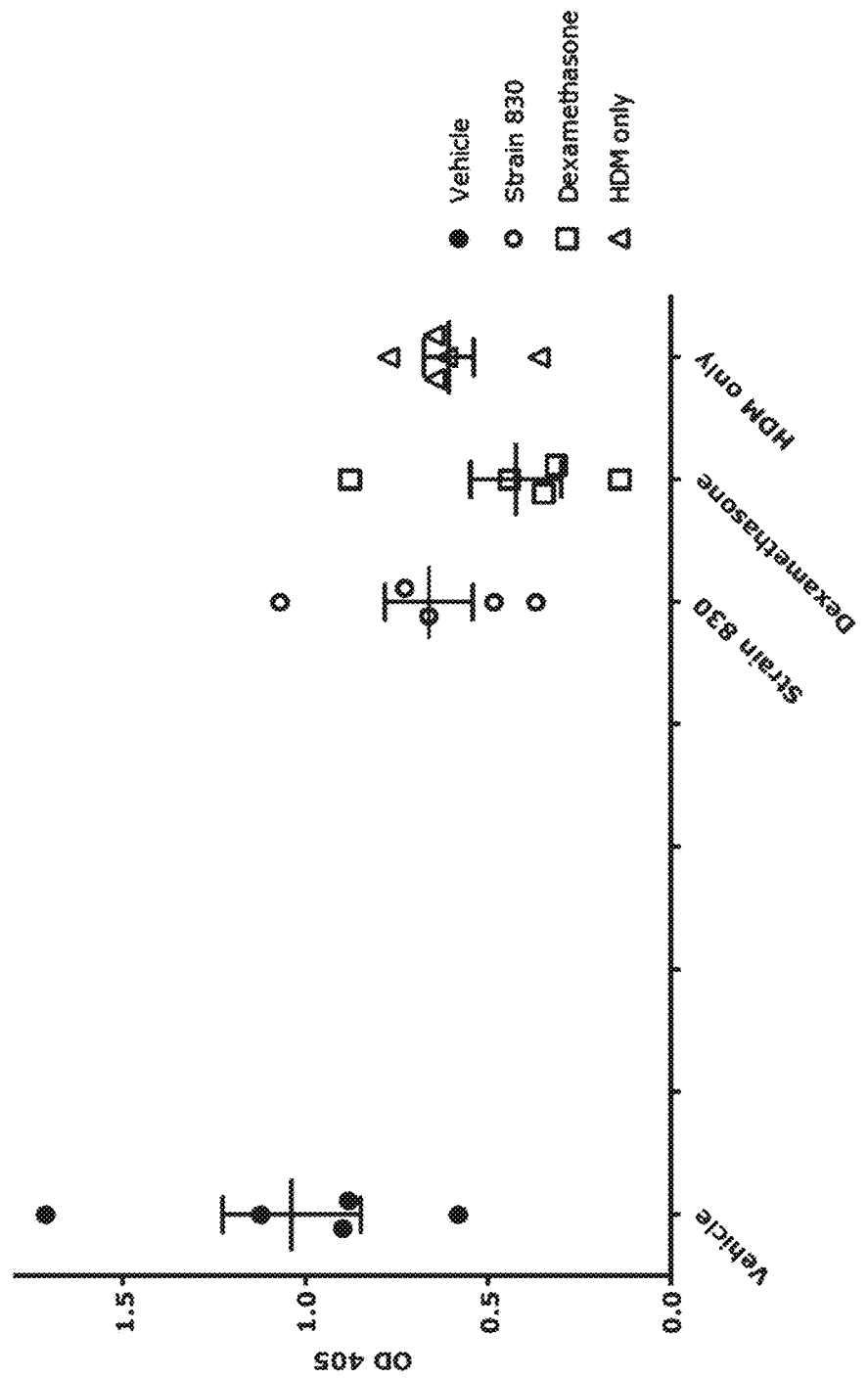
FIG. 29: Mouse model of house dust mite-induced asthma—Total IgE in BALF
Figure 30:
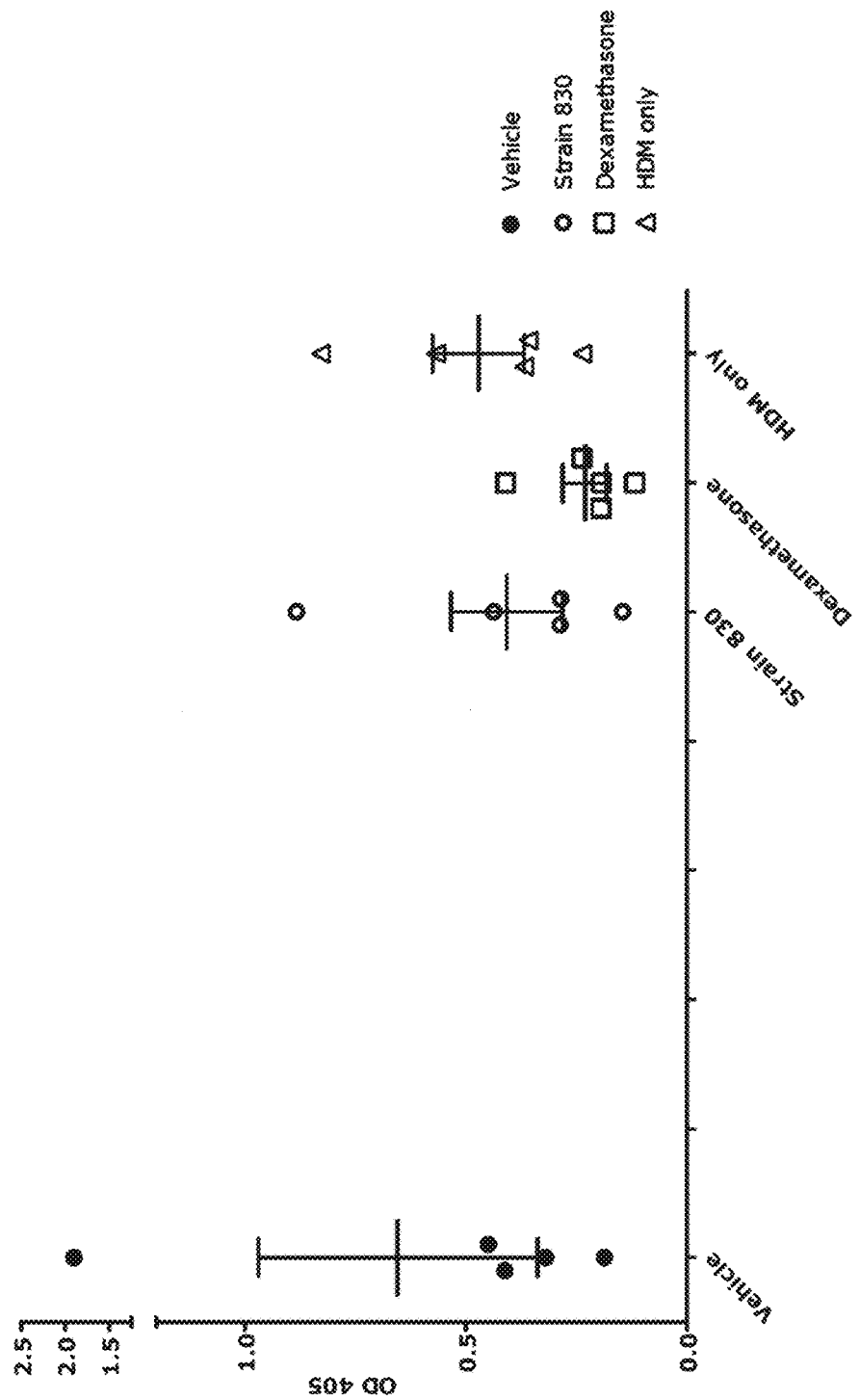
FIG. 30: Mouse model of house dust mite-induced asthma—HDM specific IgG1 in BALF

Supernatant Levels of IL-6 (FIG. 26)

Inflammatory cytokines such as IL-6 and TNF-α are not typically produced at high levels in anti-CII cultures. However, their levels may be altered as a result of immune modulation. Levels of IL-6 in CII-stimulated cultures were modest, reaching 10 pg/ml. Although higher than in media control cultures, these differences were too small to provide rationale for performing statistical analyses.

Microbiological Analysis

Bacterial growth was confirmed by measuring the optical density at 600 nm using a spectrophotometer. Bacterial identity was confirmed by comparing streaked plate pictures to reference pictures.

Following the improved bacterial preparation method, consistently high doses of bacterial strain were administered from Day −2 and Day −3 as indicated by the high OD values measured.

Faecal samples were collected and snap-frozen on Day −14, Day 0 and at termination.

Histopathology

The histopathology results are shown in FIGS. 65-69. As expected for this model, intra-individual and inter-individual variability was observed in terms of the presence/absence of arthritis or the severity of change present.

The nature of the pathology was as expected for this model, with extensive mixed chronic-active inflammation of the synovium and bursa extending to involve the peri-articular soft tissues (muscle, adipose tissue, dermal collagen). In the most severely affected joints there was articular cartilage degeneration and loss with intra-articular debris and inflammation and disruption of the joint and bone structure by fibrosis and inflammation.

The incidence of histopathological changes was: vehicle—80% (16/20); Biotherapeutic #830—20% (4/20). Treatment with Biotherapeutic #830 reduced the incidence of histopathological scores in mouse hind limbs when compared to the vehicle-treated group (see FIGS. 65-68). Histopathology scores were analysed by one-way ANOVA for non-parametric data (Kruskal-Wallis test) followed by Dunn's post-test for multiple comparisons to the vehicle-treated group. Biotherapeutic #830 induced a significant reduction of the joint inflammation scores observed in histopathology when compared to the vehicle-treated group ($p<0.01$). Biotherapeutic #830 induced a significant reduction of the cartilage damage scores observed in histopathology when compared to the vehicle-treated group ($p<0.001$). Biotherapeutic #830 induced a significant reduction of the bone damage scores observed in histopathology when compared to the vehicle-treated group ($p<0.001$). Biotherapeutic #830 induced a significant reduction of the total histopathology scores when compared to the vehicle-treated group ($p<0.001$).

Summary

Increased clinical scores were observed from Day 28 after the first administration of type II collagen, as expected in this model of arthritis in DBA/1 mice. Biotherapeutic #830 was shown to be effective at treating arthritis in this model. Biotherapeutic #830 was effective for reducing the severity of the clinical scores and for reducing pathological disease in the joints, as demonstrated in the histopathological analysis.

Proliferative recall responses to Collagen II were seen in splenocyte cultures from all experimental groups. The collagen-specific response was significantly reduced following treatment with biotherapeutic #830 (Group 3).

Most of the T cell cytokines tested showed detectable increases between Collagen II-stimulated and media controls in the Vehicle-treated group. These increases were not as obvious in the biotherapeutic-treated group. This broadly supports the proliferative recall responses to Collagen II described above.

There was evidence of suppression of the Th1/Th17 axis, which is the pathogenic response in this model and in human RA. Correlation of reduced levels of cytokines with reduced proliferation is suggestive of immune modulation. There was no evidence that this modulation resulted either from enhanced levels of Th2 associated IL-4 or with increases in the immune modulating cytokine, IL-10.

Example 4—Further Analysis of the Effect of Bacterial Inocula in the Mouse Model of House Dust Mite-Induced Asthma The mice tested in Example 1 were subjected to further analyses to further characterise the effect of the compositions of the invention on the allergic asthma inflammatory response.

Materials and Methods

Blood Withdrawal and Serum Preparation on Day 14.

Blood samples of animals were collected via cardiac puncture. Serum was isolated from the blood sample by centrifugation for 5 min at 14000 g and stored at −20° C.

Organ Removal on Day 14.

Collection of the left lung lobe in formalin for follow-on histological analysis. Collection of the right lung lobes (all remaining lobes) and removal of serum for snap freezing and follow-on analysis. Remaining BAL fluid was snap frozen for follow-on analysis.

Measurement of Antibody Levels in Serum and BAL Fluid

Total IgE and house-dust-mite (HDM) specific IgG1 antibody production were measured in the BAL and serum by ELISA assay.

Isolation of Lung and Histological Analysis

Left lung lobes were fixed in formalin followed by embedment in paraffin, sectioning, and staining with hematoxylin and eosin and PAS. Subsequent histological scoring was performed blinded as followed: Five random fields of view per sample were scored for inflammation (peribronchial infiltration and perivascular infiltration) and mucus production. Inflammatory infiltration was scored with the following grading system:

0—normal
1—mild inflammatory infiltrates
2—moderate inflammatory infiltrates
3—marked inflammatory infiltrates
4—severe inflammatory infiltrates
5—very severe inflammatory infiltrates In each field of view, airways were measured in size and mucus cell numbers were quantified/um.

Measurement of Inflammatory Mediators in Lung Tissue

Right lung lobes (all remaining lobes) isolated for quantification of inflammatory mediators were snap frozen for subsequent measurement of CCL11, IFN-gamma, IL-1 alpha, IL-1 beta, IL-4, IL-5, IL-9, IL-17A, CXCL1, CCL3, CXCL2 and CCL5 by commercially available multiplex assay (Merck-Millipore). Analysis was performed according to the manufacturer's instructions.

Results and Analysis

The results of the experiments are shown in FIGS. 27-45.

Figure 31:
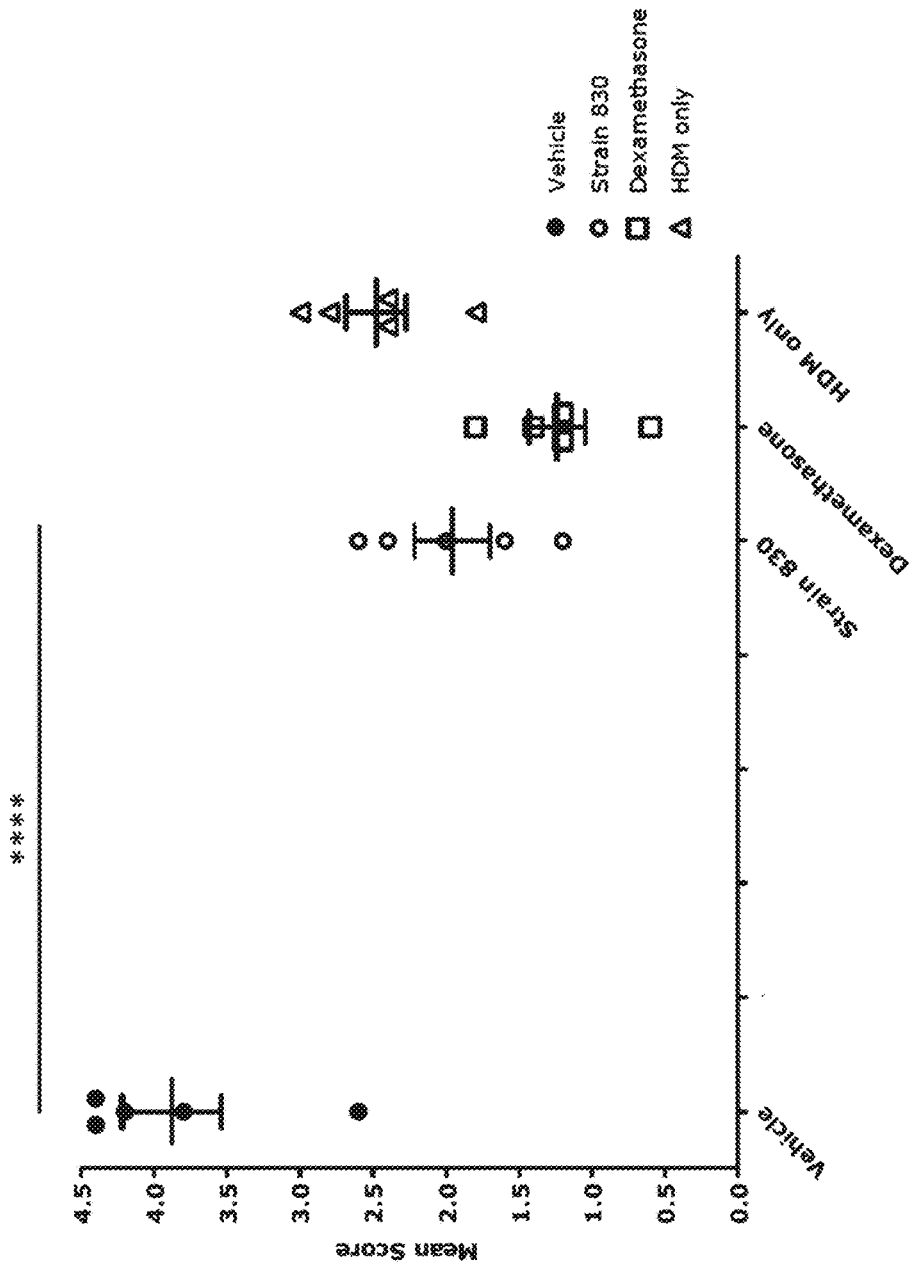
FIG. 31: Mouse model of house dust mite-induced asthma—Histological Analysis—Mean Peribronchiolar Infiltration Score
Figure 32:
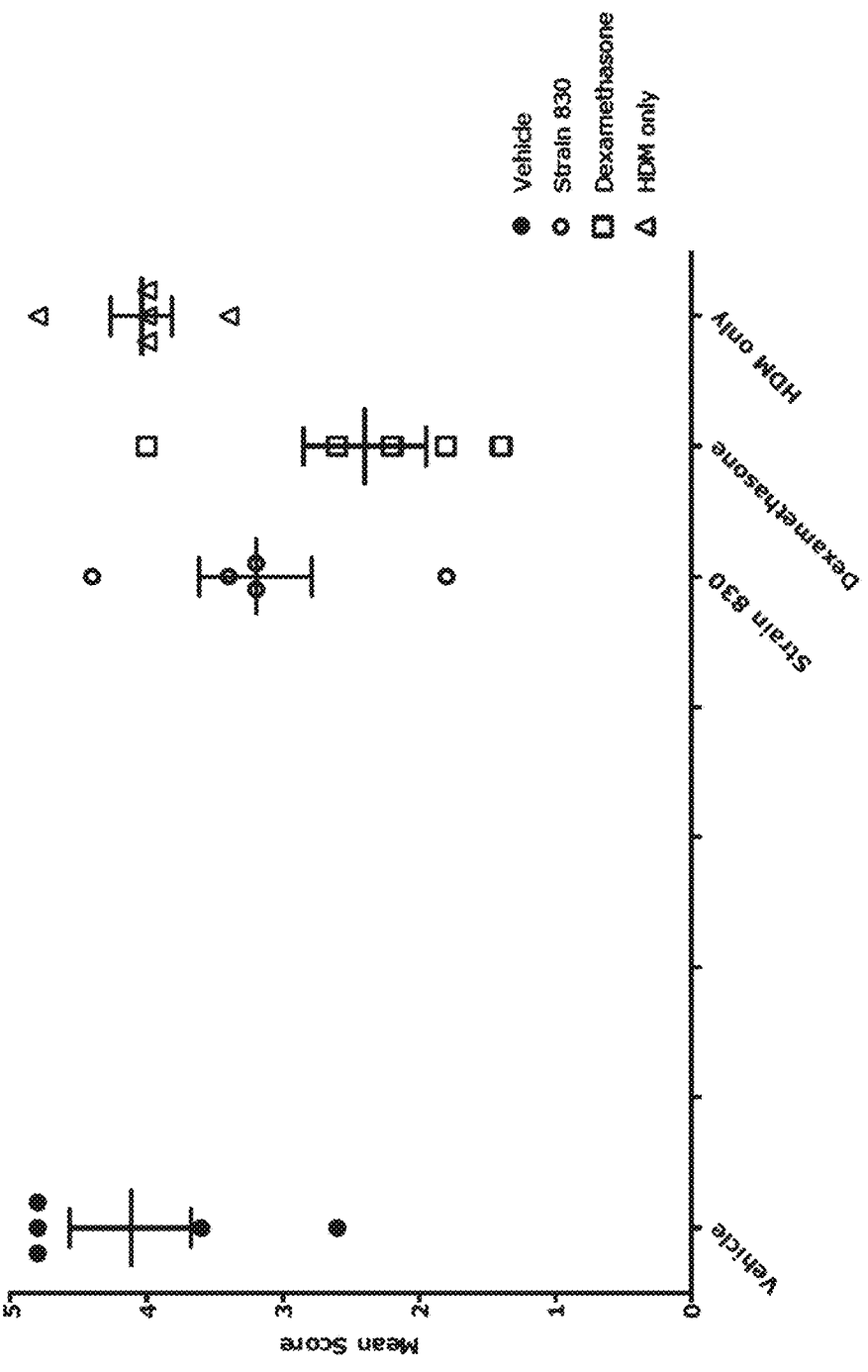
FIG. 32: Mouse model of house dust mite-induced asthma—Histological Analysis—Mean Perivascular Infiltration Score
Figure 33:
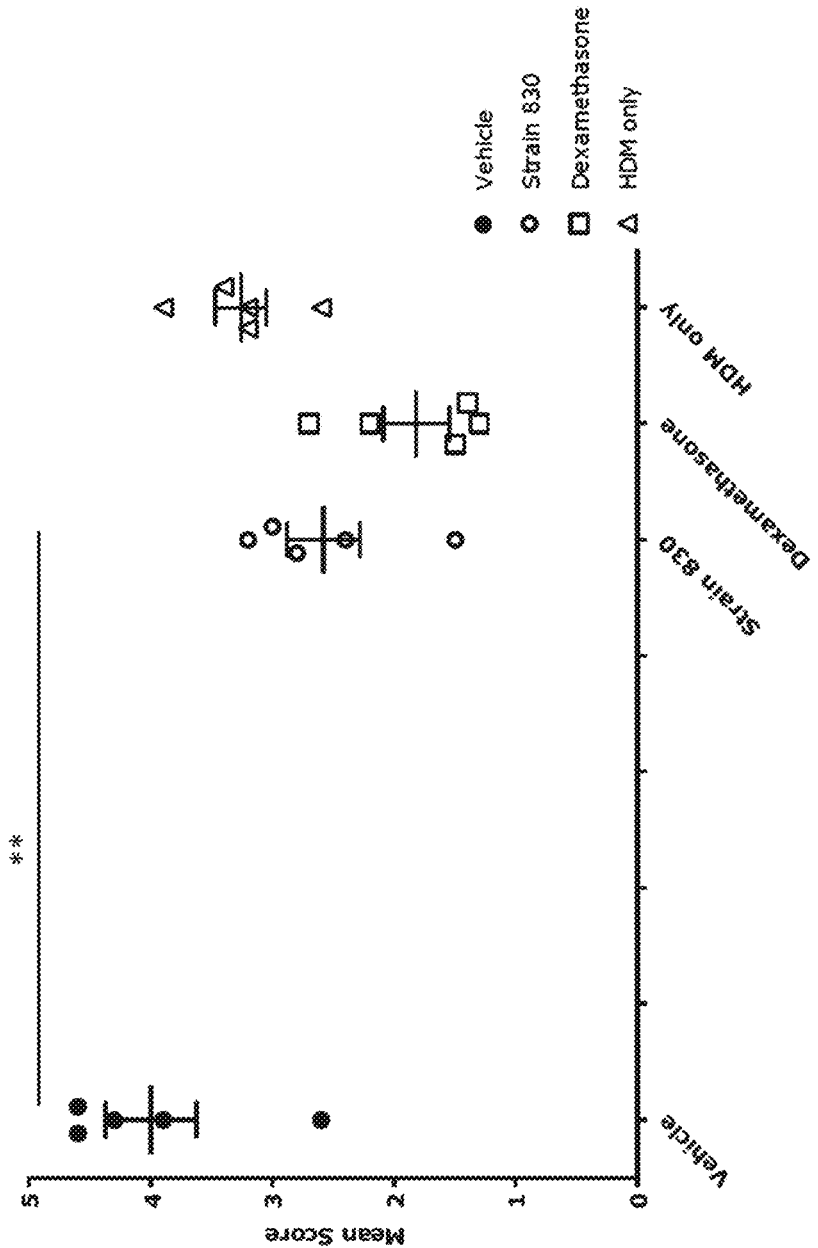
FIG. 33: Mouse model of house dust mite-induced asthma—Histological Analysis—Mean Inflammatory Score (Average of both Peribronchiolar and Perivascular Infiltration Score)
Figure 34:
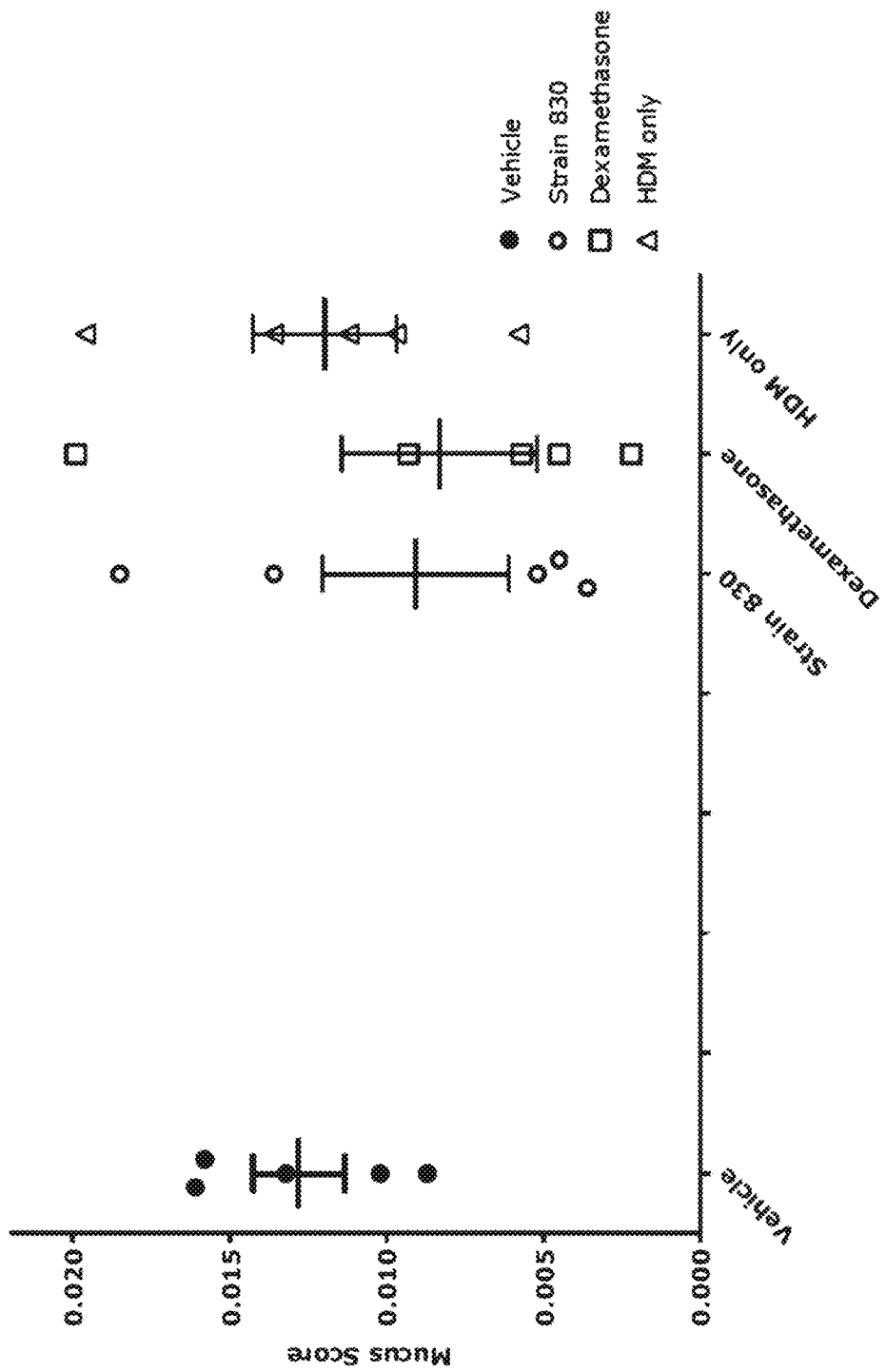
FIG. 34: Mouse model of house dust mite-induced asthma—Histological Analysis—Mucus Score
Figure 35:
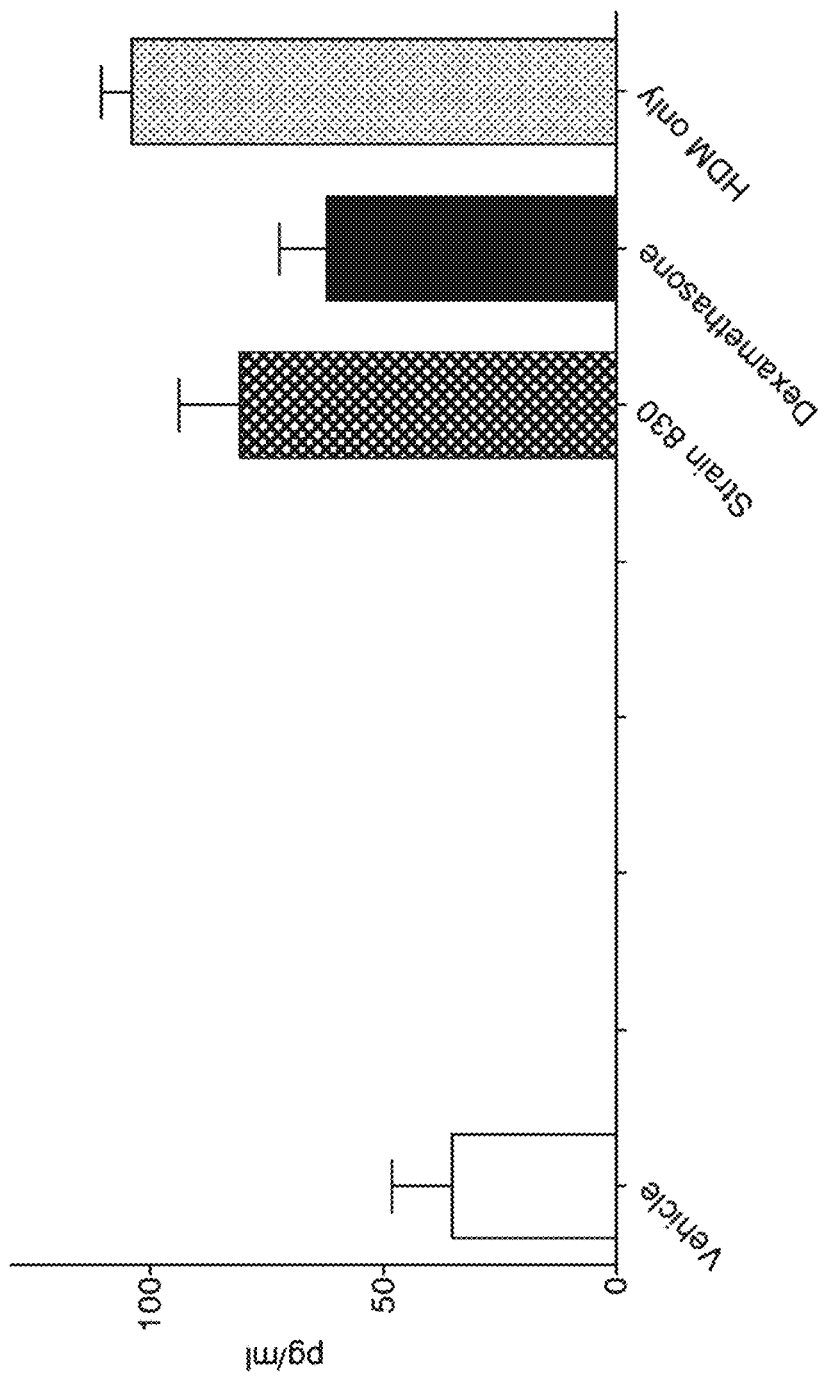
FIG. 35: Mouse model of house dust mite-induced asthma—IL-9 level in lung tissue
Figure 36:
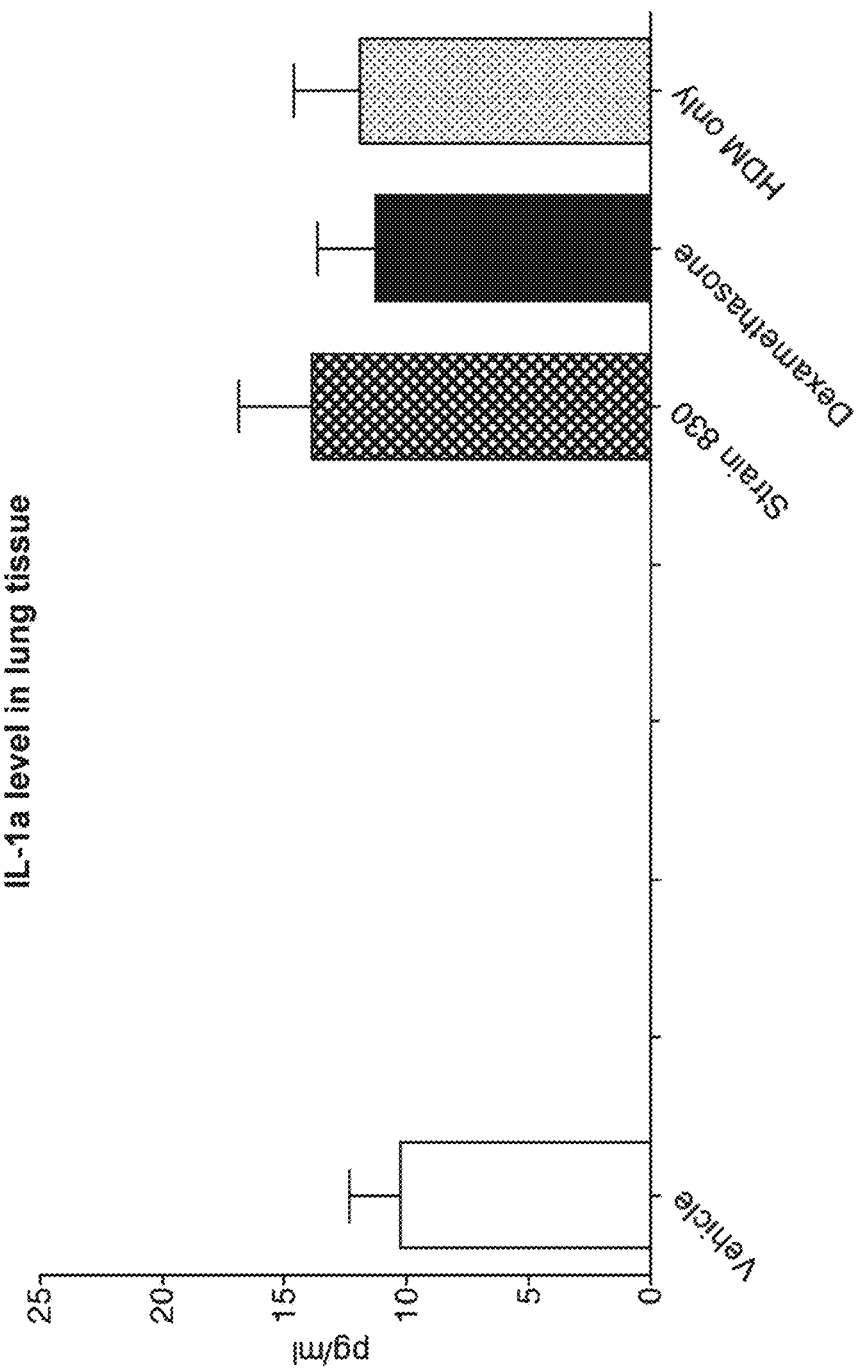
FIG. 36: Mouse model of house dust mite-induced asthma—IL-1a level in lung tissue
Figure 37:
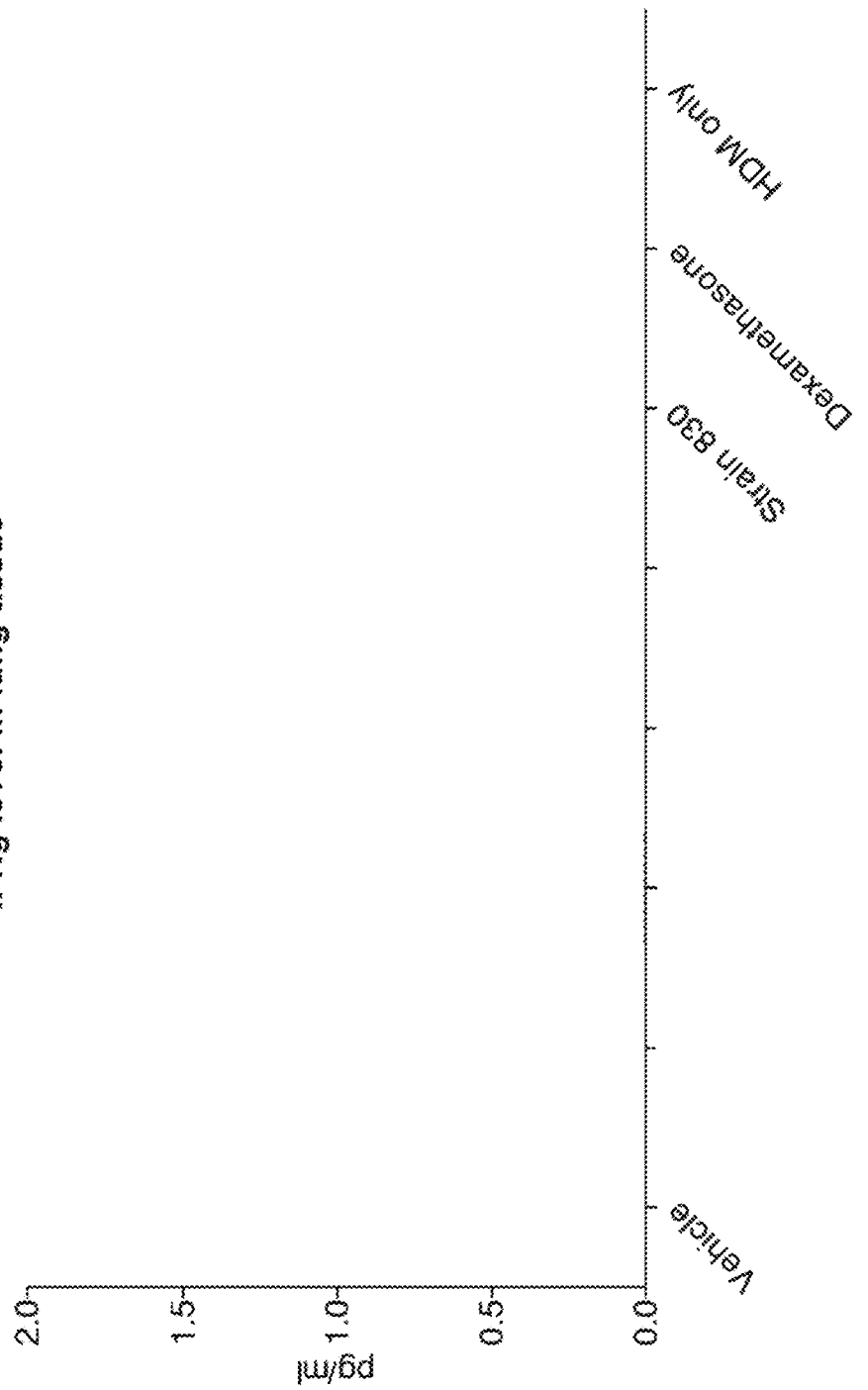
FIG. 37: Mouse model of house dust mite-induced asthma—IFNγ level in lung tissue
Figure 38:
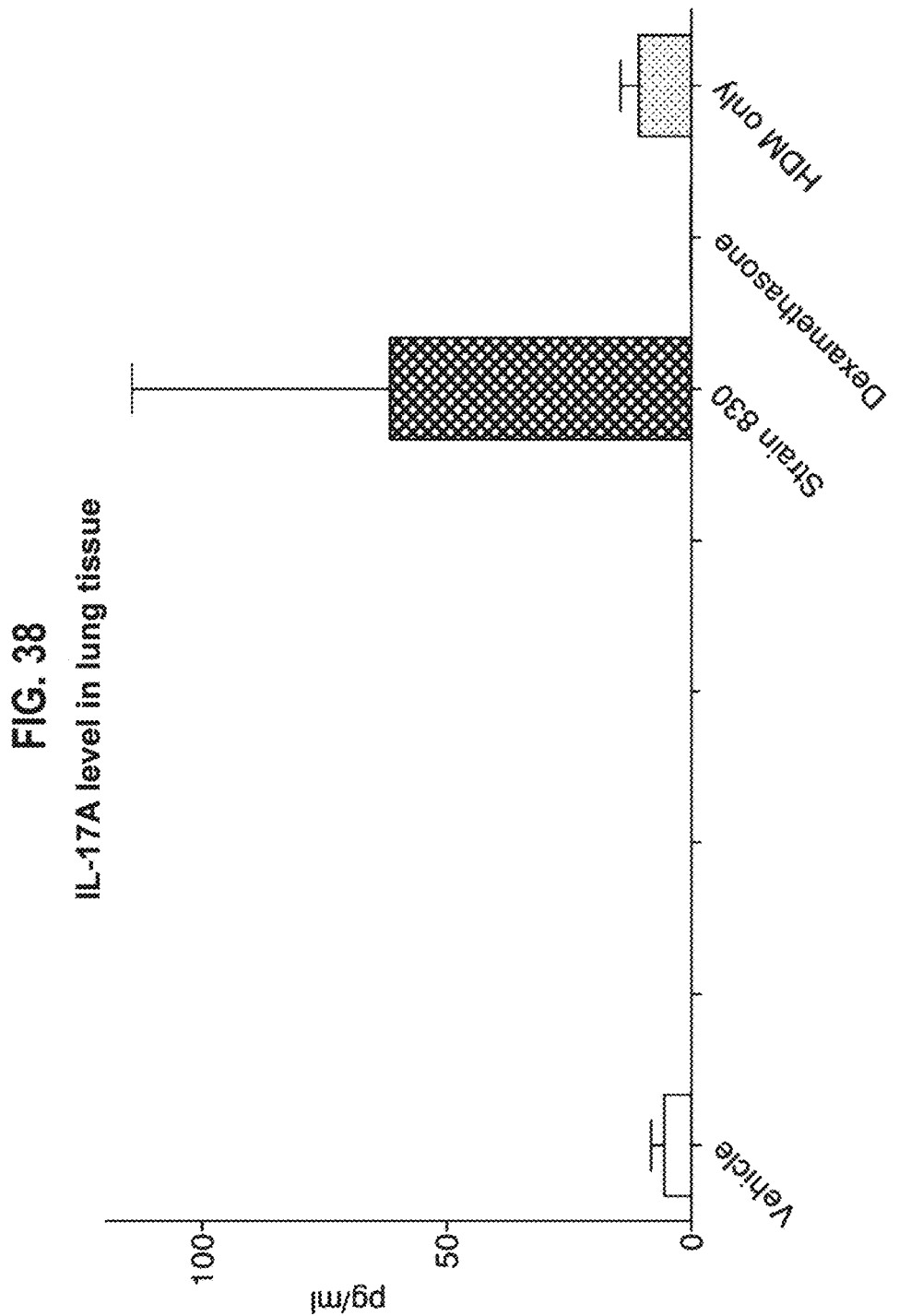
FIG. 38: Mouse model of house dust mite-induced asthma—IL-17A level in lung tissue
Figure 39:
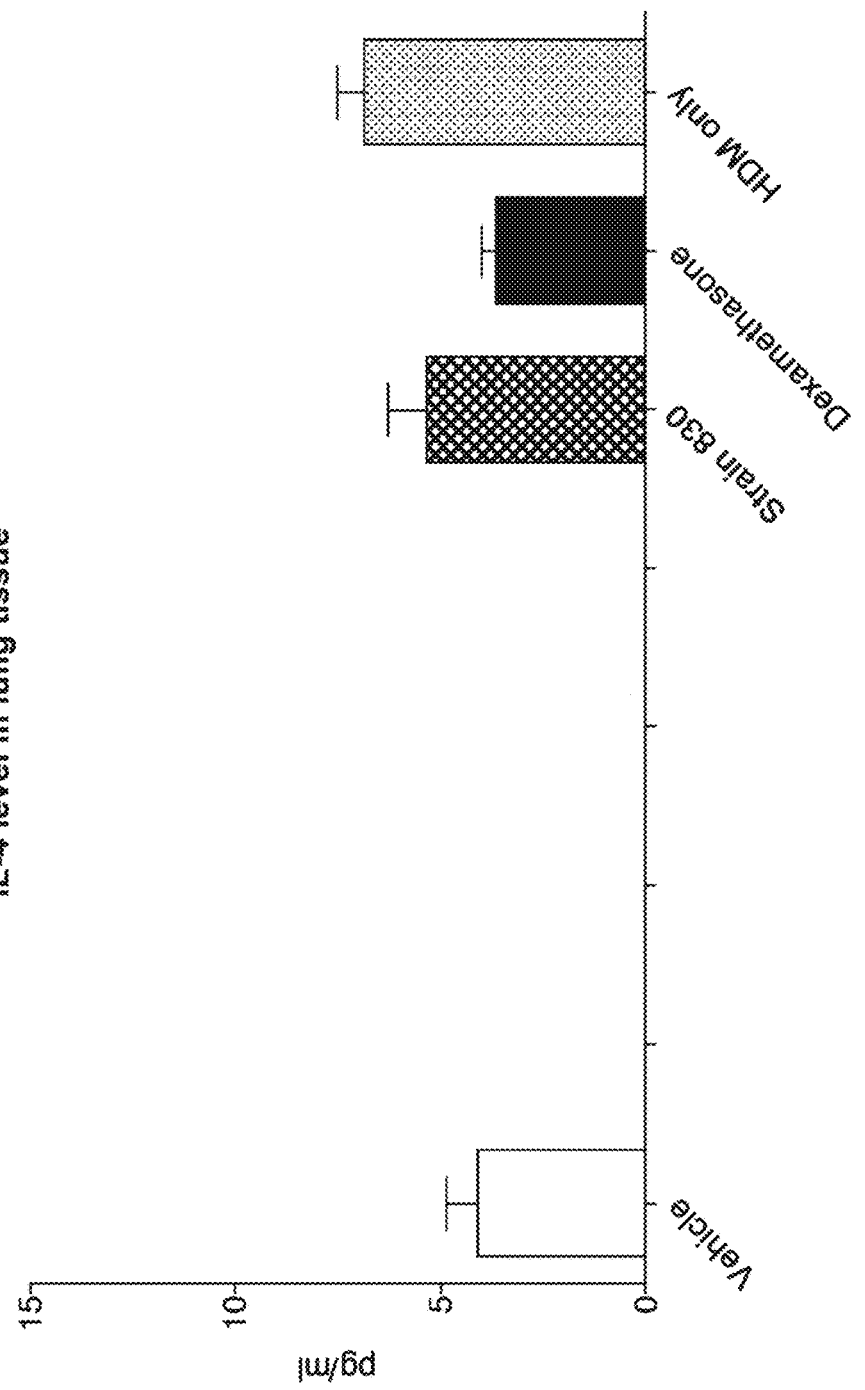
FIG. 39: Mouse model of house dust mite-induced asthma—IL-4 level in lung tissue
Figure 40:
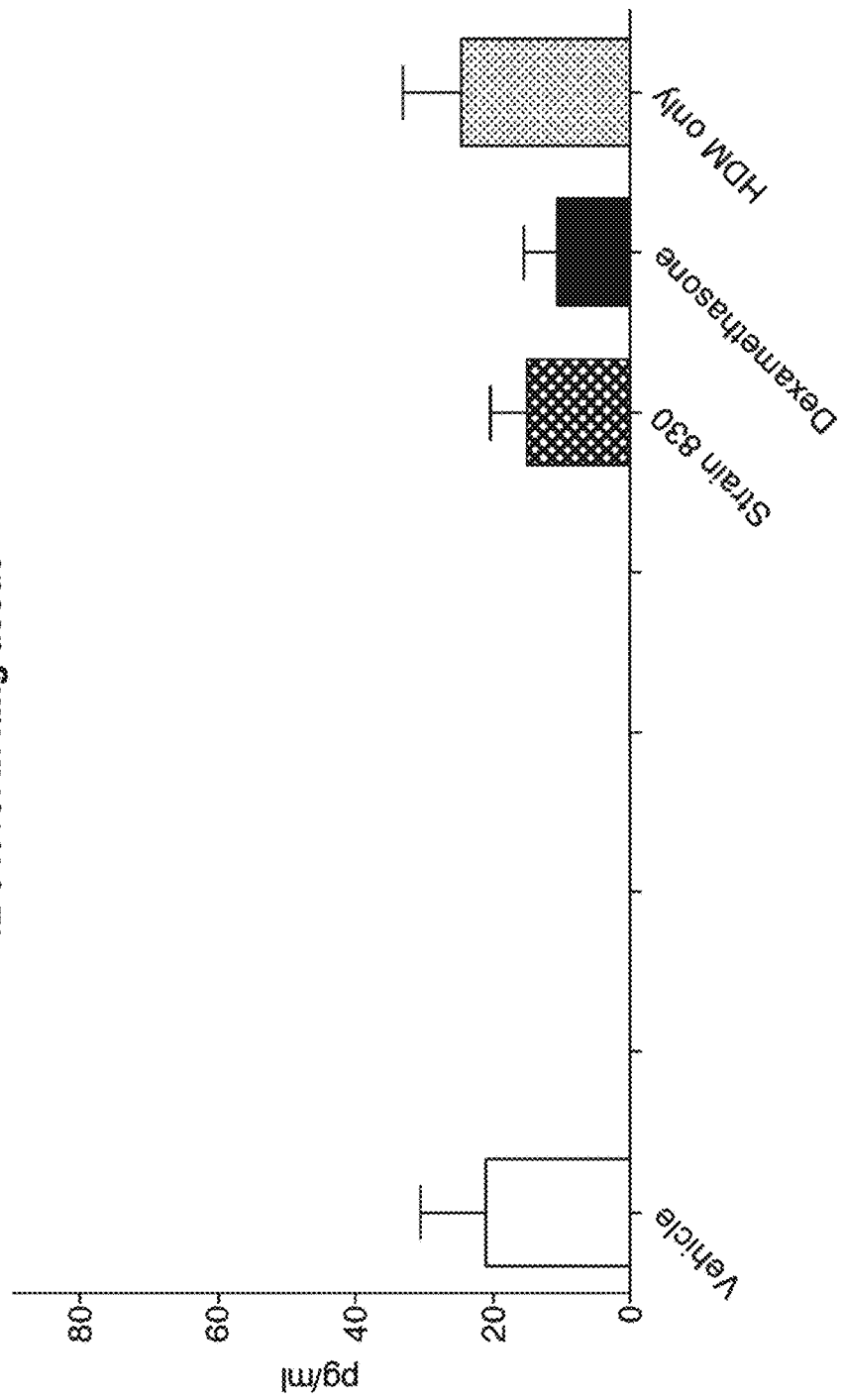
FIG. 40: Mouse model of house dust mite-induced asthma—IL-5 level in lung tissue
Figure 41:
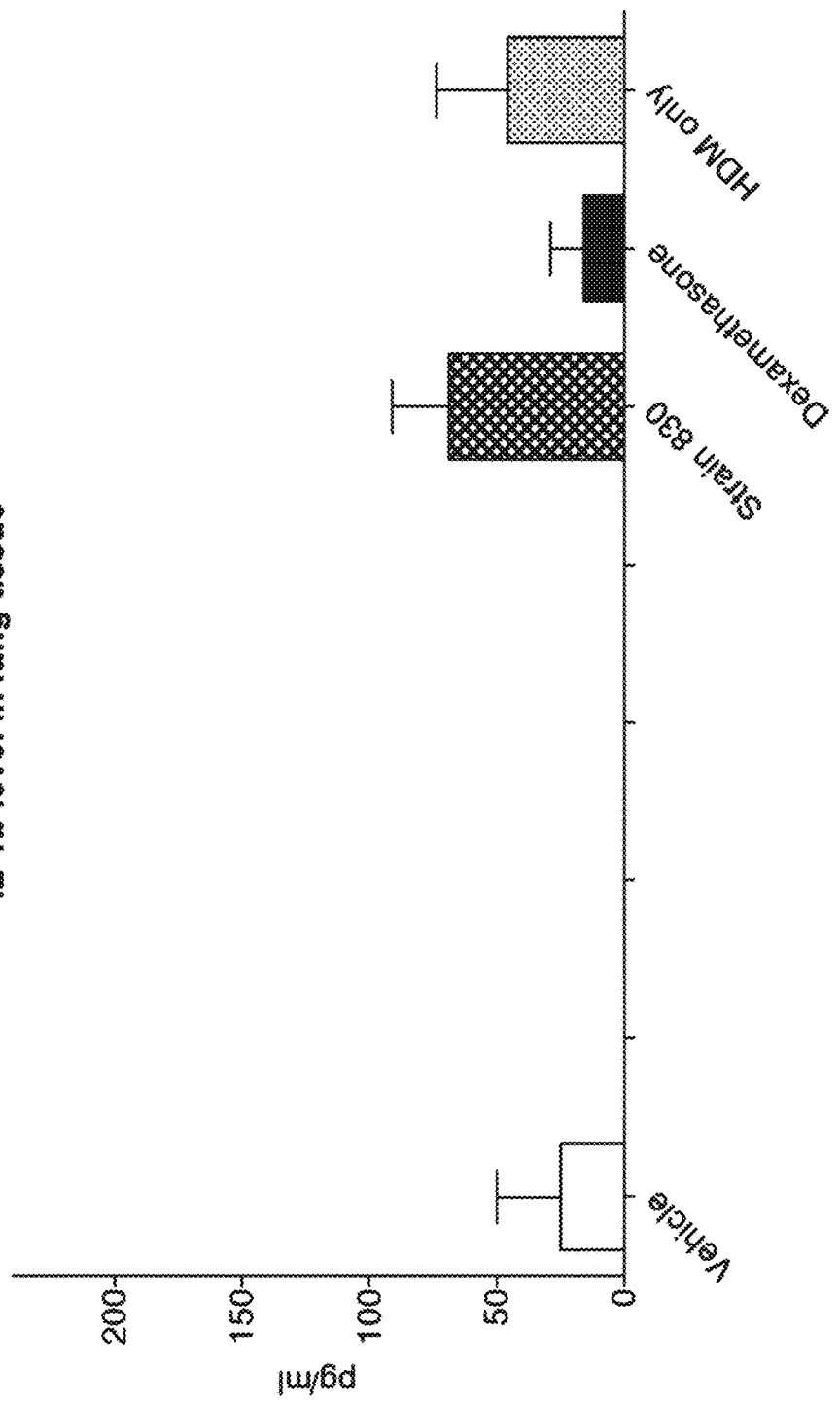
FIG. 41: Mouse model of house dust mite-induced asthma—IL-1b level in lung tissue
Figure 42:
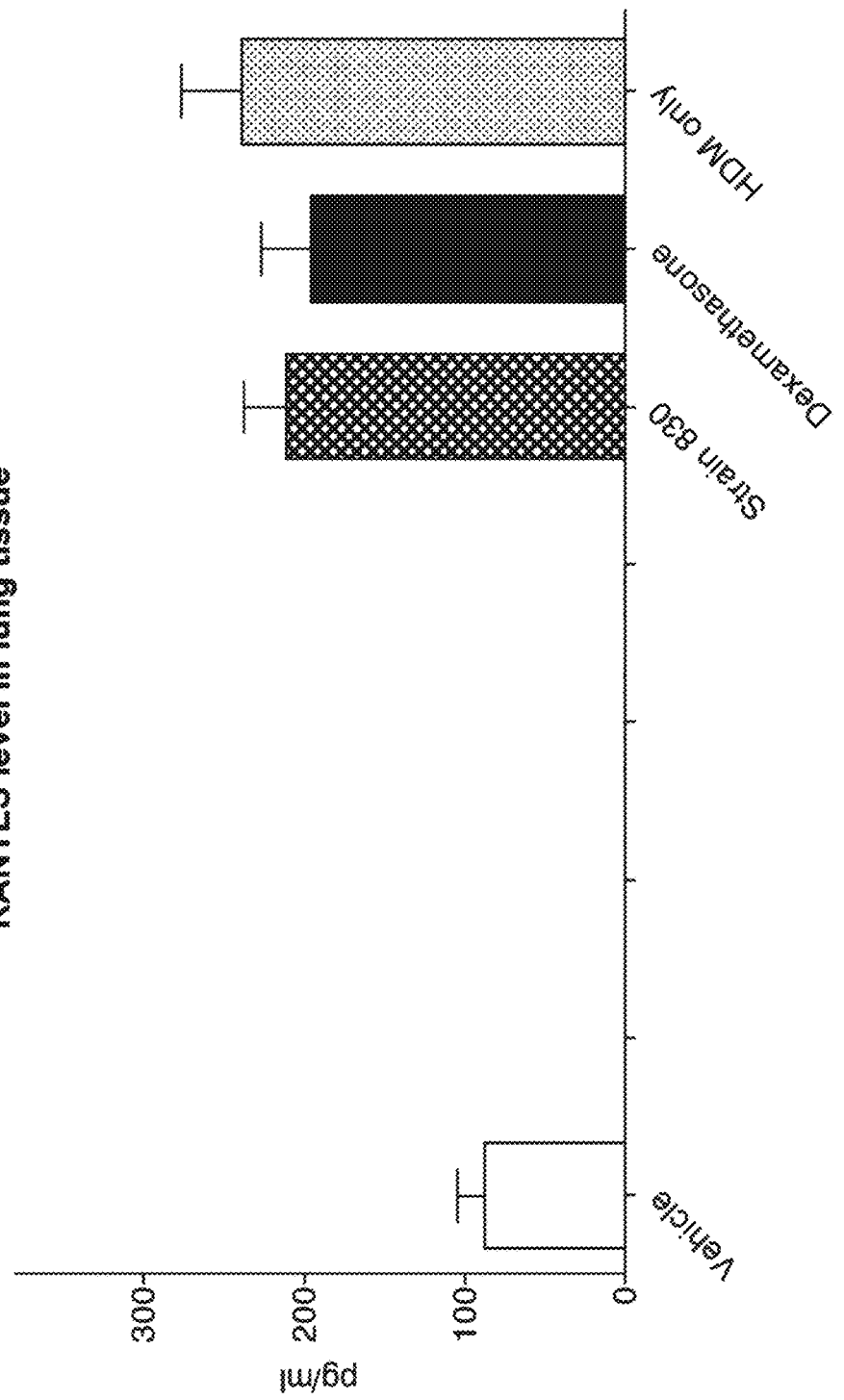
FIG. 42: Mouse model of house dust mite-induced asthma—RANTES level in lung tissue
Figure 43:
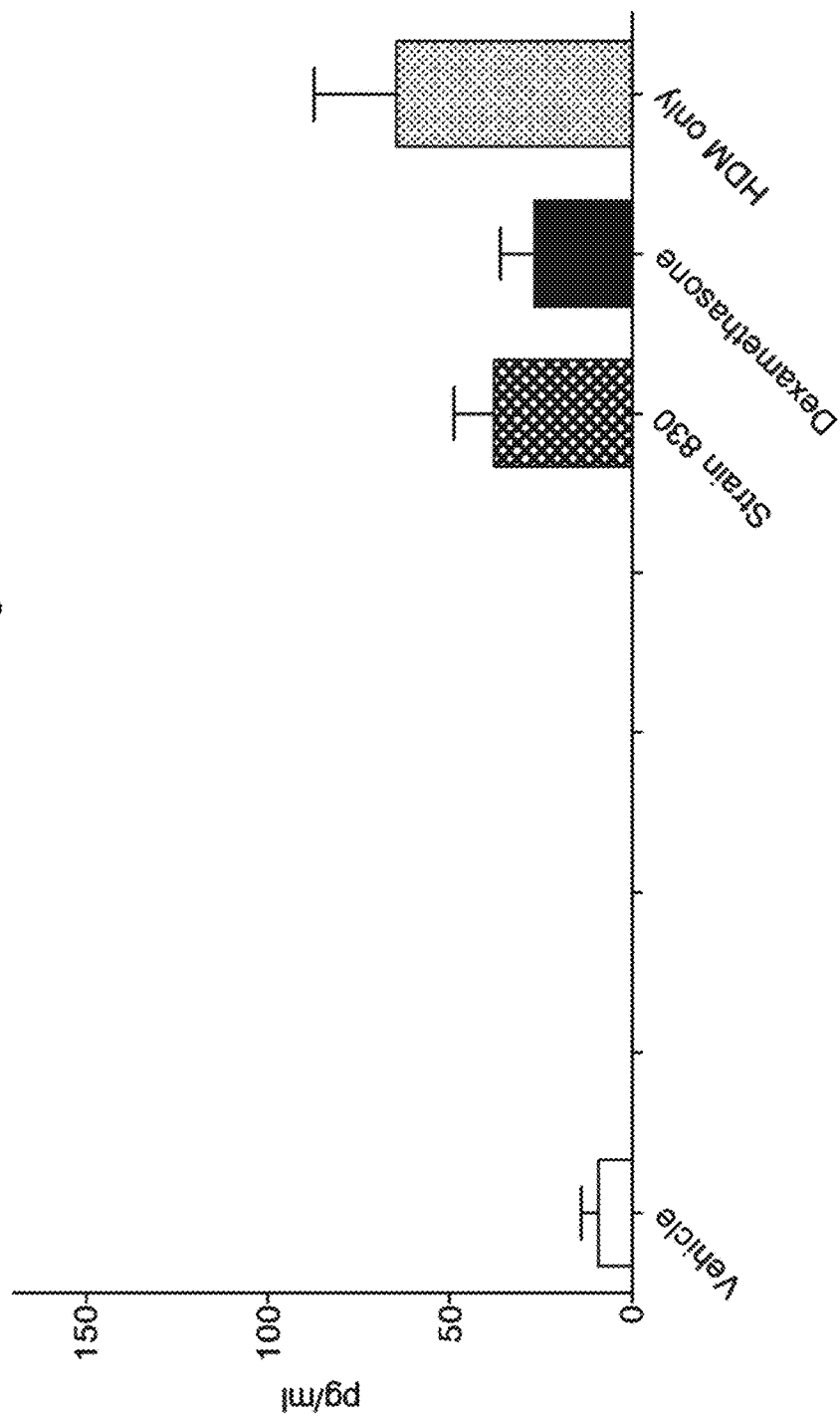
FIG. 43: Mouse model of house dust mite-induced asthma—MIP-1a level in lung tissue
Figure 44:
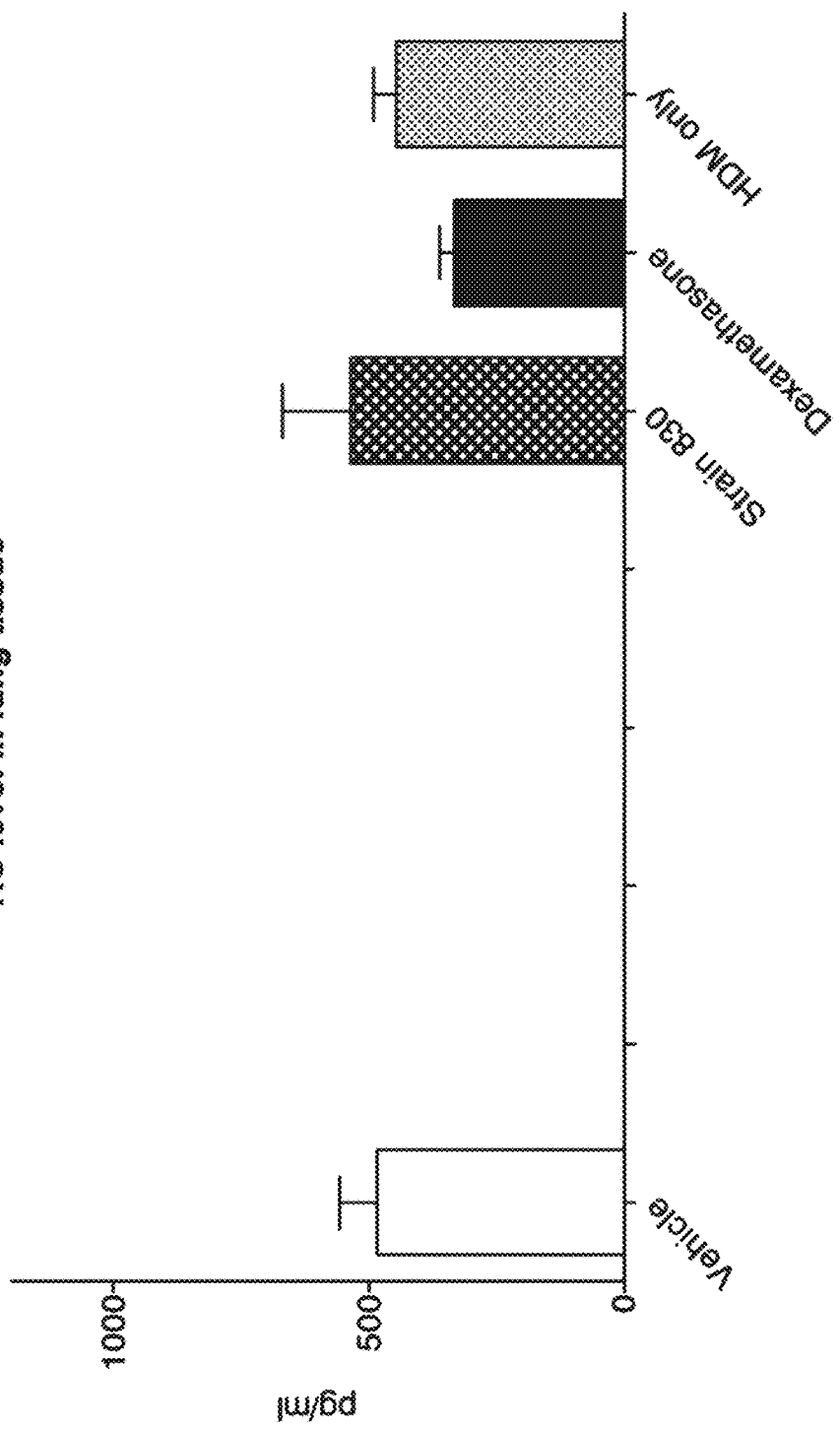
FIG. 44: Mouse model of house dust mite-induced asthma—KC level in lung tissue
Figure 45:
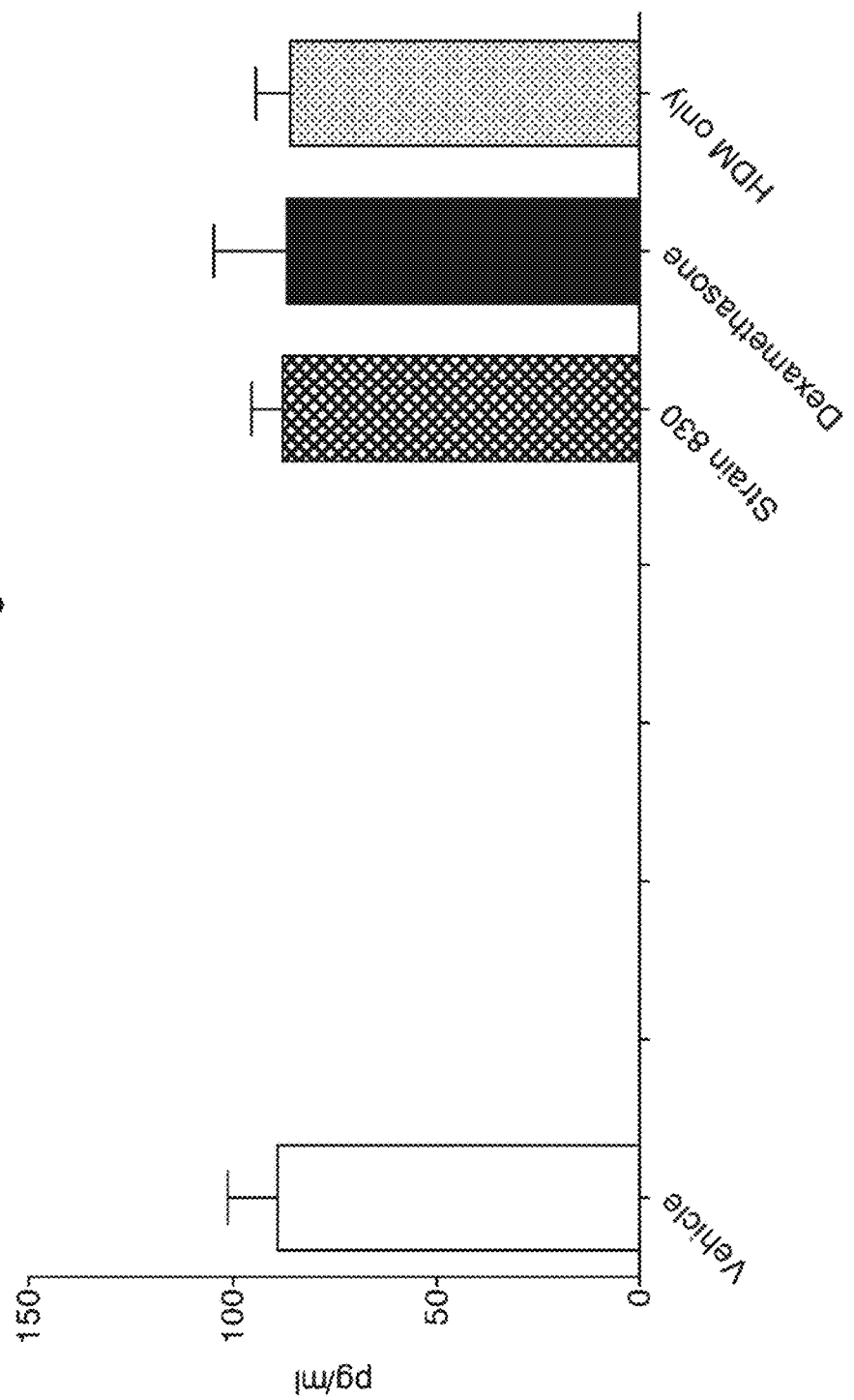
FIG. 45: Mouse model of house dust mite-induced asthma—MIP-2 level in lung tissue
Figure 46:
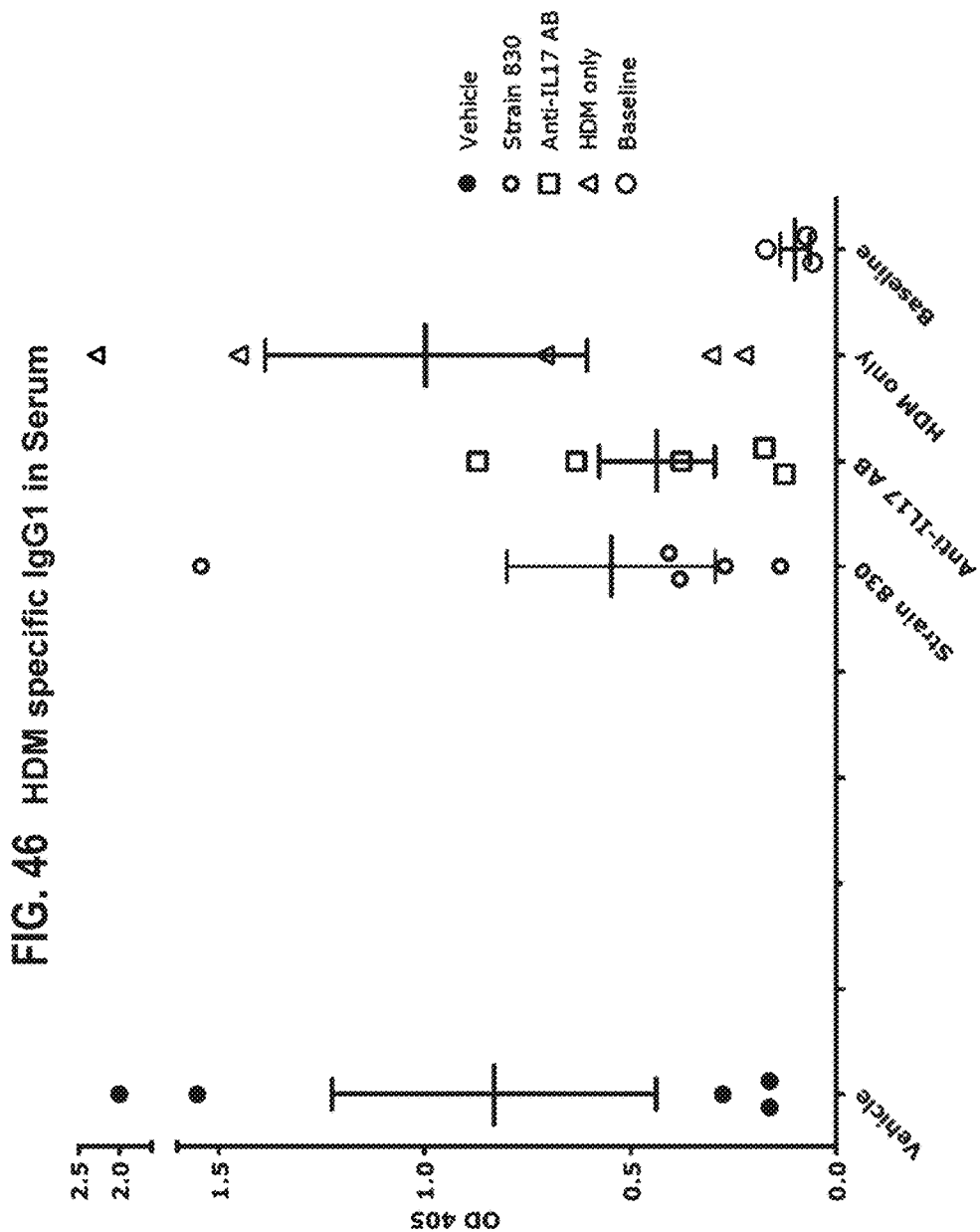
FIG. 46: Mouse model of severe neutrophilic asthma—HDM specific IgG1 in Serum
Figure 47:
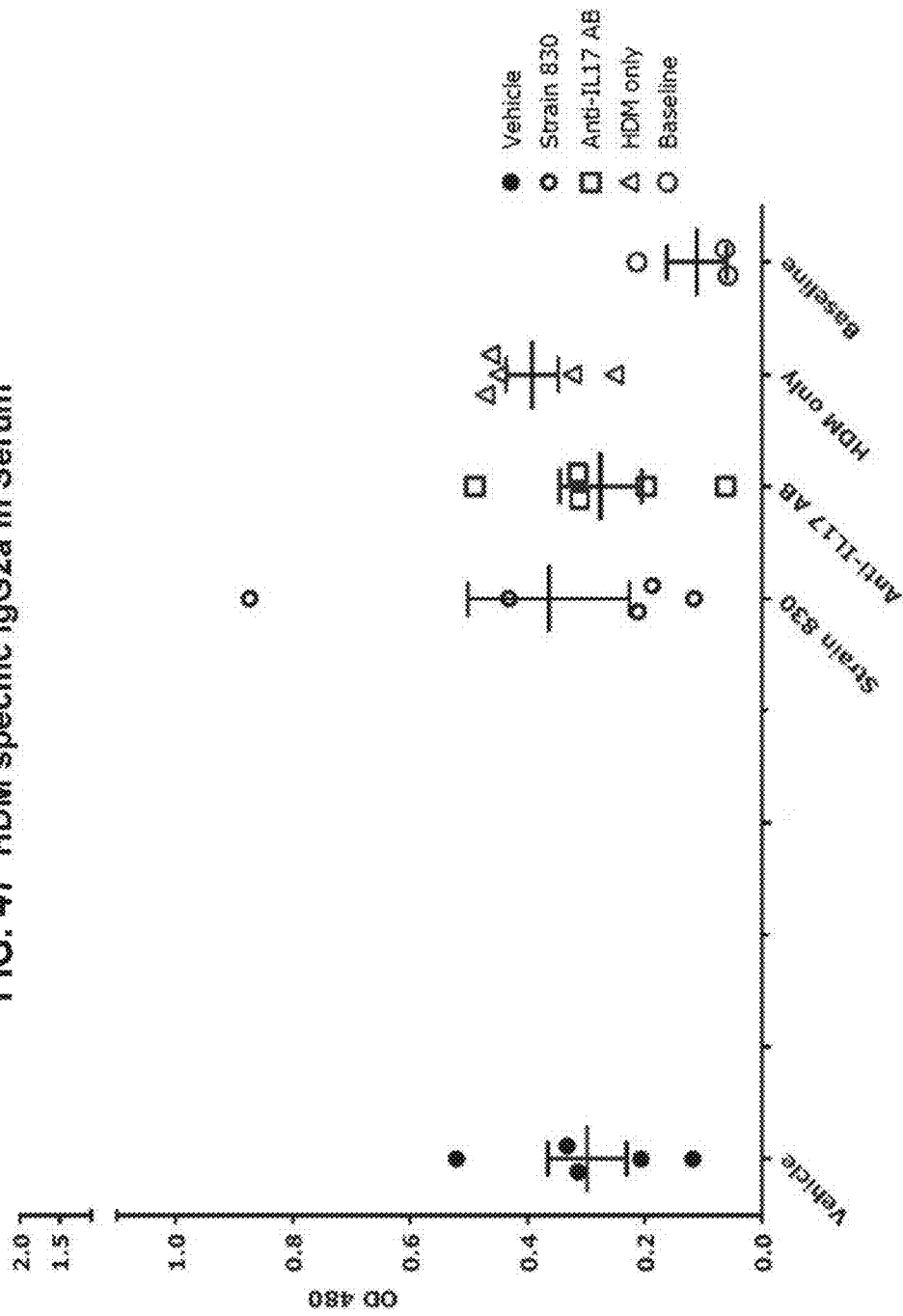
FIG. 47: Mouse model of severe neutrophilic asthma—HDM specific IgG2a in Serum
Figure 48:
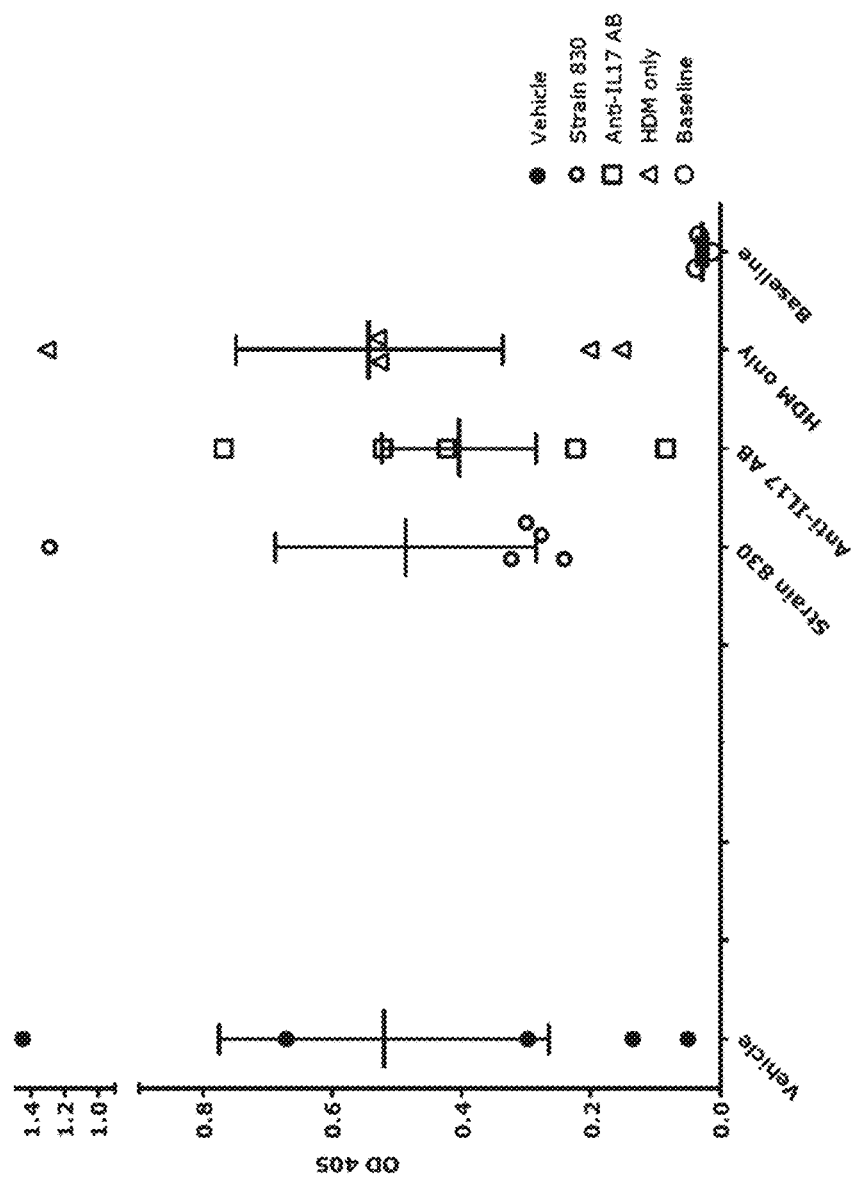
FIG. 48: Mouse model of severe neutrophilic asthma—HDM specific IgG1 in BALF
Figure 49:
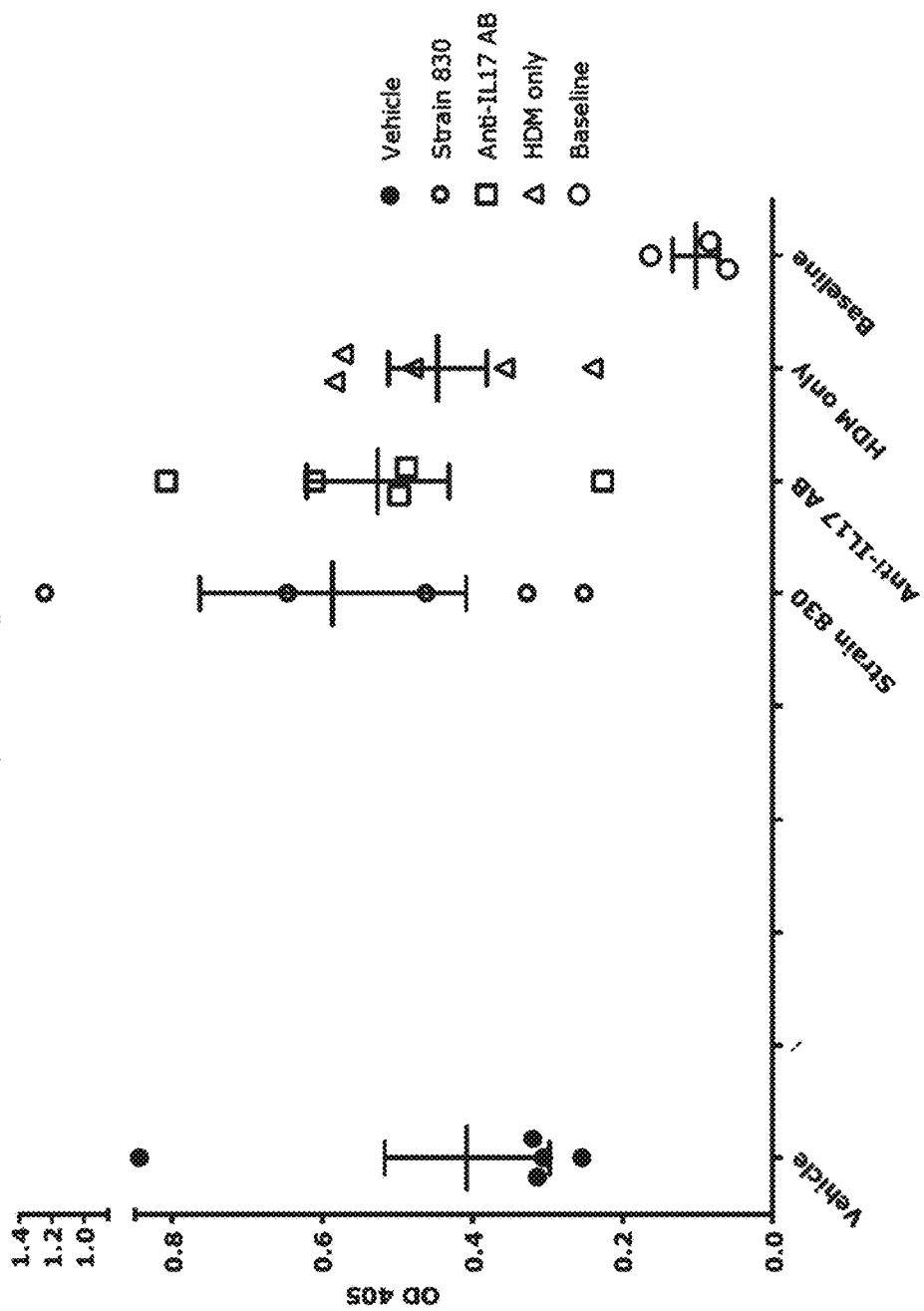
FIG. 49: Mouse model of severe neutrophilic asthma—HDM specific IgG2a in BALF
Figure 50:
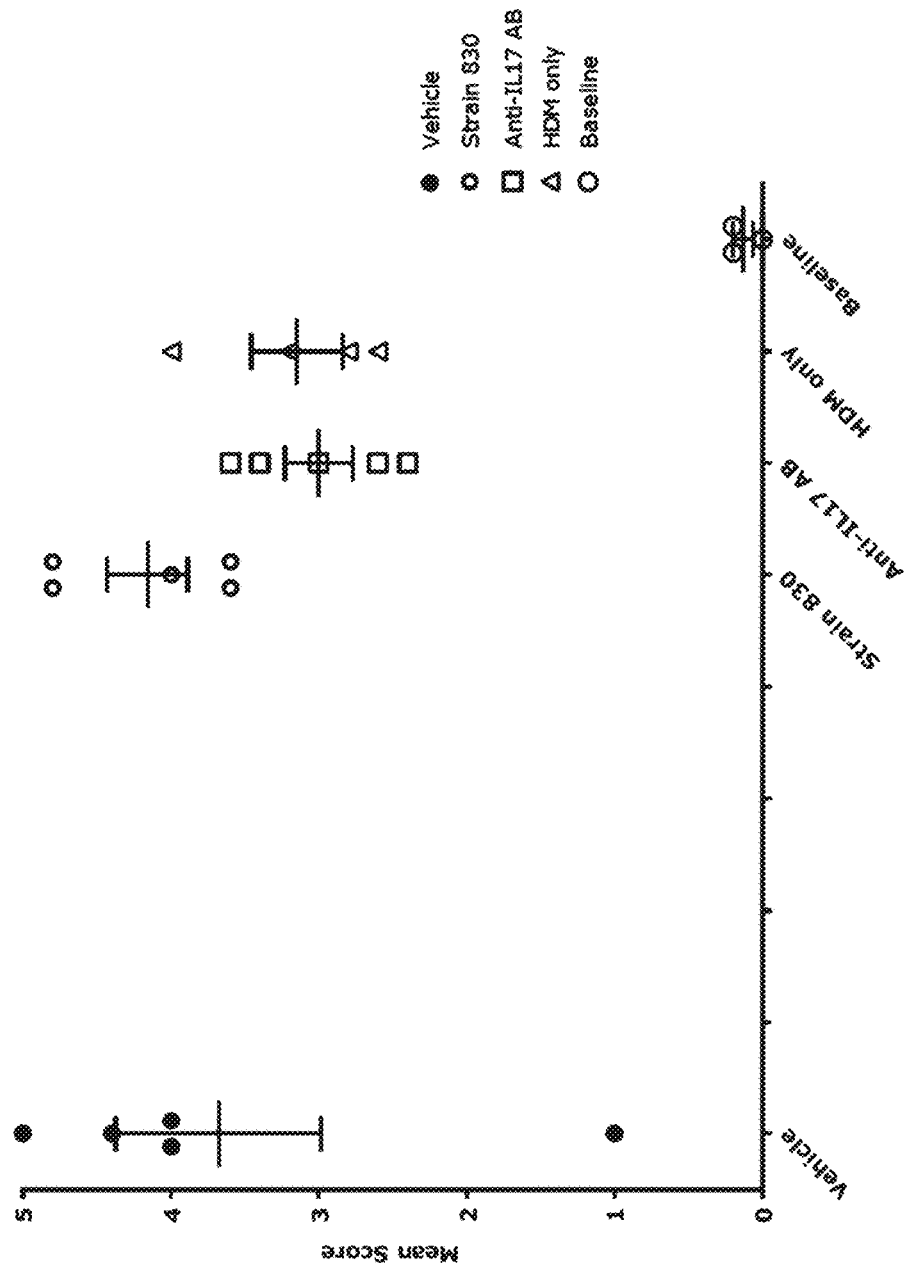
FIG. 50: Mouse model of severe neutrophilic asthma—Histological Analysis—Mean Peribronchiolar Infiltration Score
Figure 51:
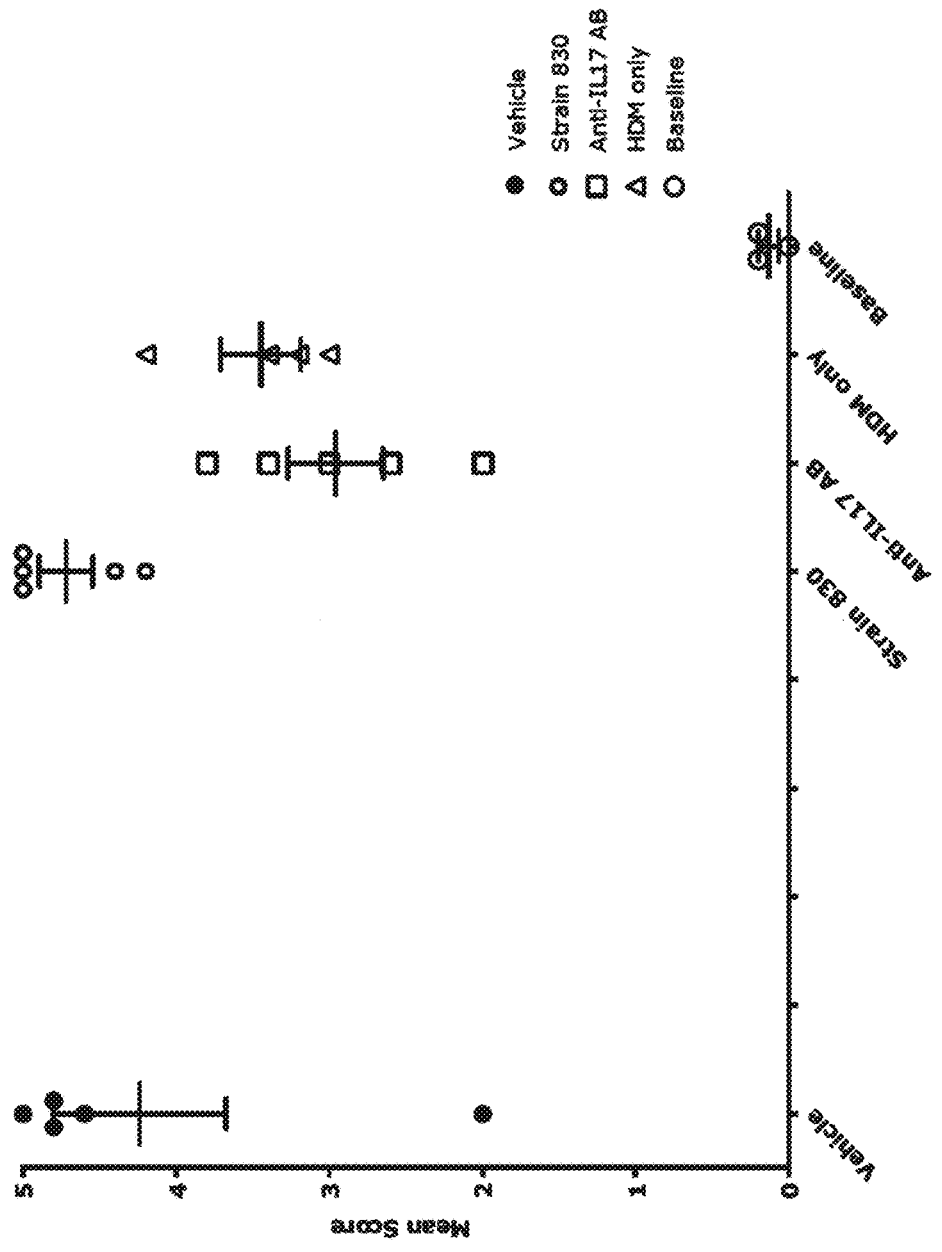
FIG. 51: Mouse model of severe neutrophilic asthma—Histological Analysis—Mean Perivascular Infiltration Score
Figure 52:
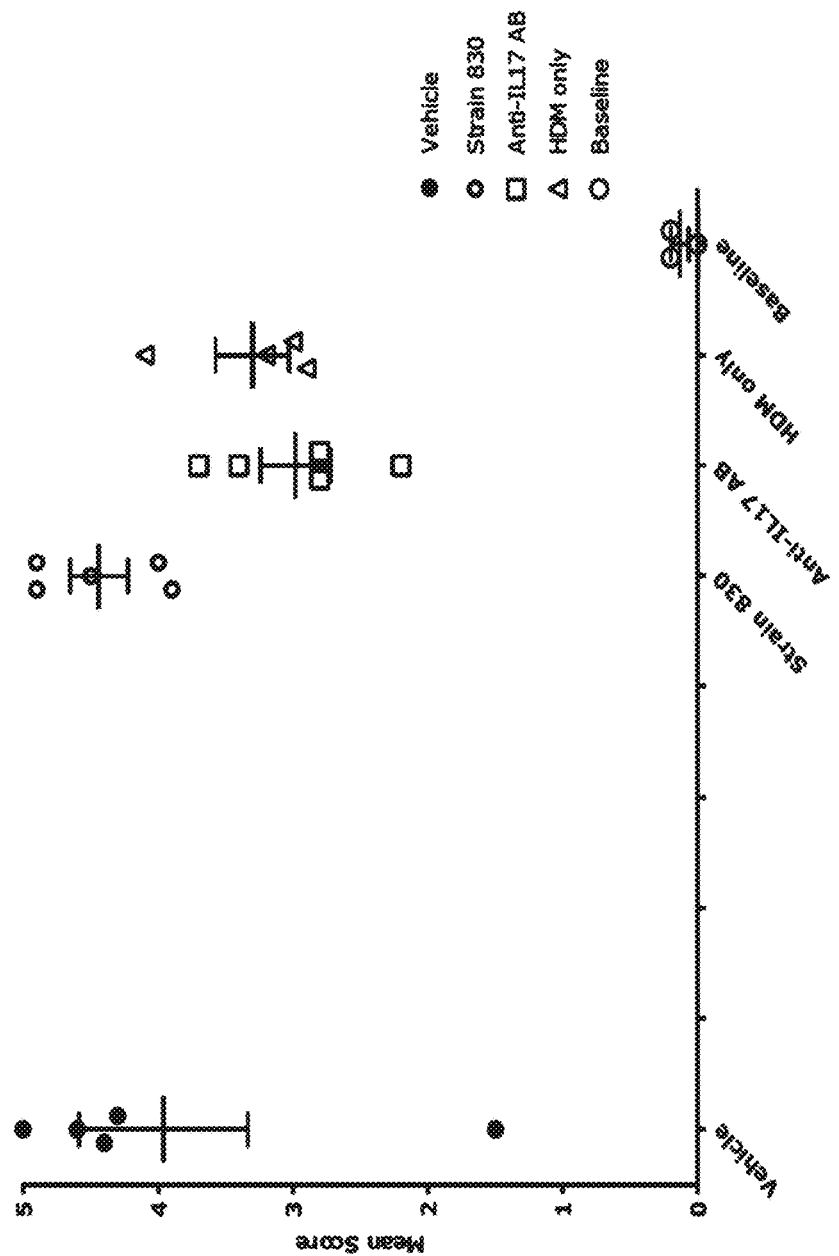
FIG. 52: Mouse model of severe neutrophilic asthma—Histological Analysis—Mean Inflammatory Score (Average of both Peribronchiolar and Perivascular Infiltration Score)

In support of the findings described in Example 1, analysis of the cellular infiltrates in the lung tissue of mice treated with strain 830 showed a notable and statistically significant reduction in mean inflammation score (see FIGS. 31 and 33).

Antibody levels in the BAL fluid and serum were analysed (see FIGS. 27-30). No clear effect of the bacterial treatment on serum antibody levels was observed. This may reflect a failure in the experiment, because the spread of data and the error bars for each treatment are large, and the positive and negative controls do not appear to have behaved as would be expected. Also, the baseline serum antibody levels could have masked any changes.

Similarly, no clear effect of the bacterial treatment on cytokine levels in lung tissue was observed (see FIGS. 35-45). Again, this may reflect a failure in the experiment, because the spread of data and the error bars for each treatment are large, and the positive and negative controls do not appear to have behaved as would be expected. It is also possible that the mechanism of action involved influences earlier cytokine responses that were no longer detectable on day 4 post the final HDM airway challenge. Some care should be taken when interpreting the cytokine data in the current study, due to the variability in the levels detected. This variability could in part be explained by the fact that the lung tissue was separated for the different analyses, and thus one lung lobe might not have been fully representative or comparable to the same lobe in other mice due to patchy distribution of the inflammation.

Example 5—Further Analysis of the Effect of Bacterial Inocula in the Mouse Model of Severe Neutrophilic Asthma The mice tested in Example 2 were subjected to further analyses to further characterise the effect of the compositions of the invention on the neutrophilic response associated with severe asthma.

Materials and Methods

Organ Removal on Day 18.

Collection of the left lung lobe in formalin for follow-on histological analysis. Collection of the right lung lobes (all remaining lobes) and removal of serum for snap freezing and follow-on analysis. Remaining BAL fluid was snap frozen for follow-on analysis.

Measurement of Inflammatory Mediators in Lung Tissue (Follow-on Analysis).

Right lung lobes (all remaining lobes) isolated for quantification of inflammatory mediators were snap frozen for subsequent measurement of IFN-gamma, IL-1 alpha, IL-1 beta, CXCL1, CCL3, CXCL2, CCL5, IL-17A, TNF-alpha, IL-17F, IL-23 and IL-33 by commercially available multiplex assay (Merck-Millipore). Analysis was performed according to the manufacturer's instructions.

Measurement of Antibody Levels in Serum and BAL Fluid (Follow-on Analysis).

House-dust-mite (HDM) specific IgG1 and IgG2a antibody production were measured in the BAL and serum by ELISA assay.

Isolation of Lung and Histological Analysis (Follow-on Analysis).

Left lung lobes were fixed in formalin followed by embedment in paraffin, sectioning, and staining with hematoxylin and eosin and PAS. Subsequent histological scoring was performed blinded as followed: Five random fields of view per sample were scored for inflammation (peribronchial infiltration and perivascular infiltration) and mucus production. Inflammatory infiltration was scored with the following grading system:

0—normal
1—mild inflammatory infiltrates
2—moderate inflammatory infiltrates
3—marked inflammatory infiltrates
4—severe inflammatory infiltrates
5—very severe inflammatory infiltrates Results and Analysis The results of the experiments are shown in FIGS. 46-63.

In relation to cytokine levels, as for Example 4, the spread of data and the error bars for each treatment are large, and the positive and negative controls do not appear to have behaved as necessarily would be expected. It is also possible that the mechanism of action involves influencing earlier cytokine responses that were no longer detectable on day 4 post the final HDM airway challenge. Some care should be taken when interpreting the cytokine data in the current study, due to the variability in the levels detected. This variability could in part be explained by the fact that the lung tissue was separated for the different analyses, and thus one lung lobe might not have been fully representative or comparable to the same lobe in other mice due to patchy distribution of the inflammation. Despite this variability, a clear anti-inflammatory effect on cytokine levels for strain 830 was shown, and the positive control anti-IL-17 Ab generally behaved as expected.

Figure 53:
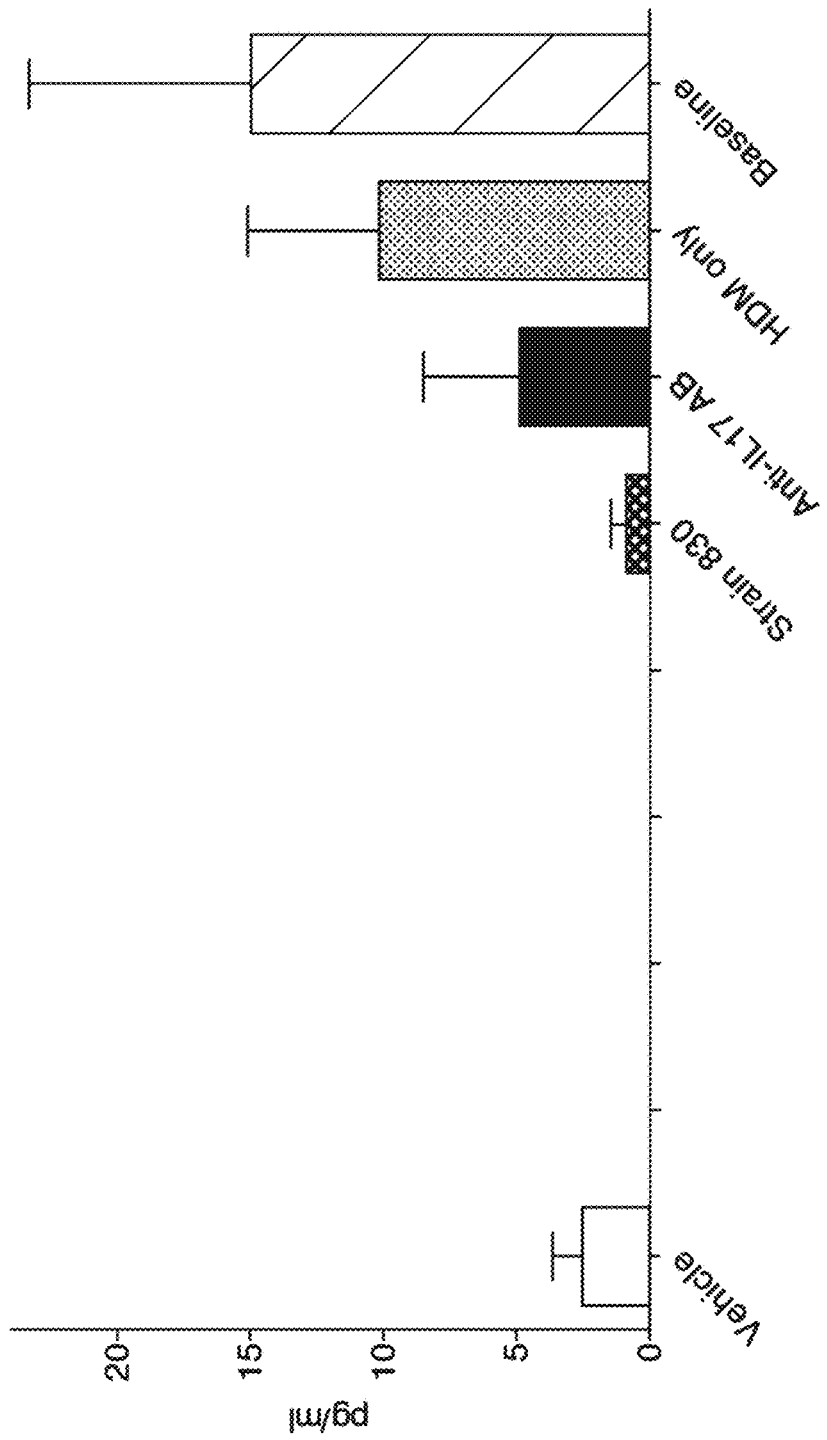
FIG. 53: Mouse model of severe neutrophilic asthma—TNFα level in lung tissue
Figure 54:
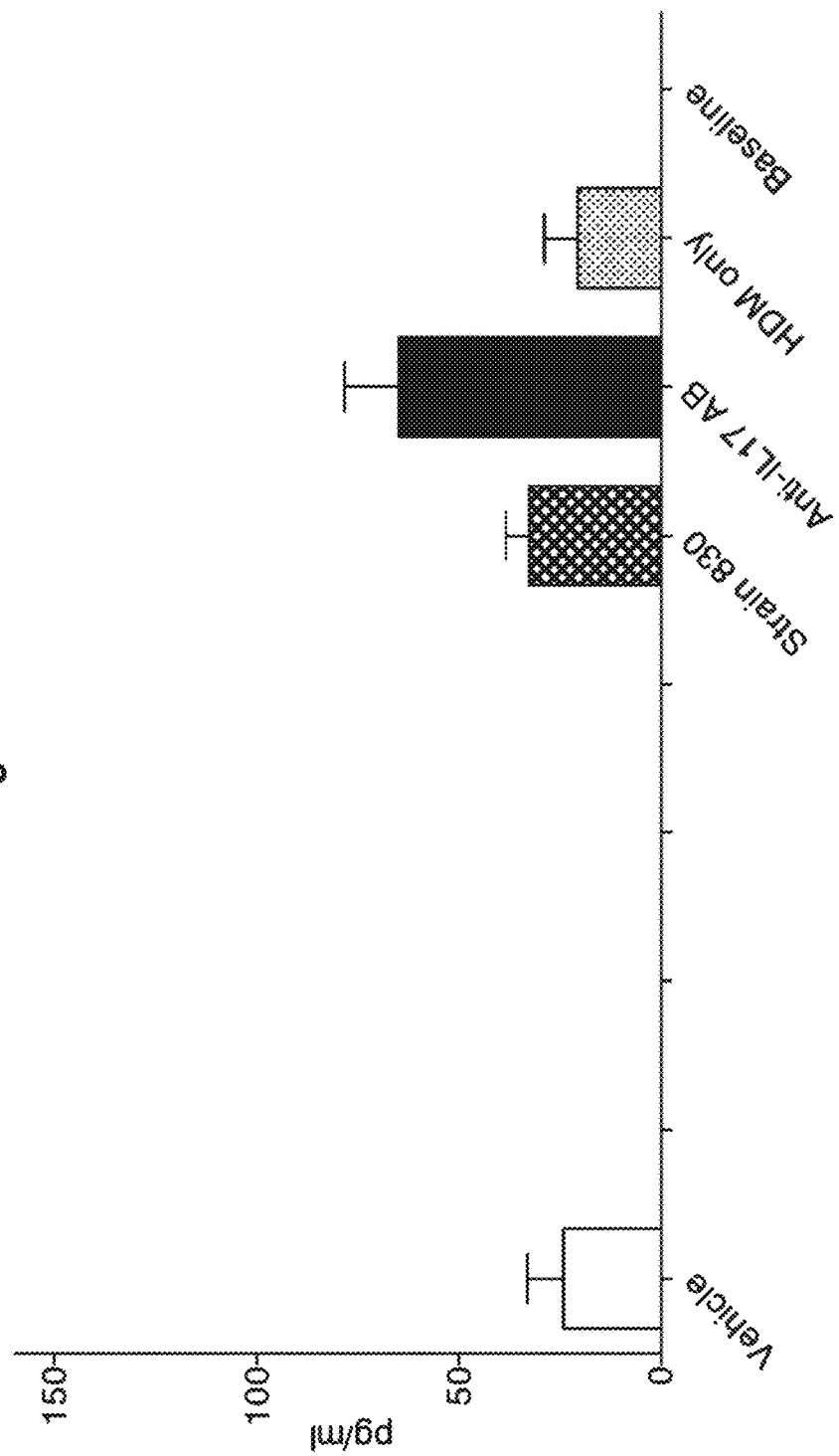
FIG. 54: Mouse model of severe neutrophilic asthma—IL-1a level in lung tissue
Figure 55:
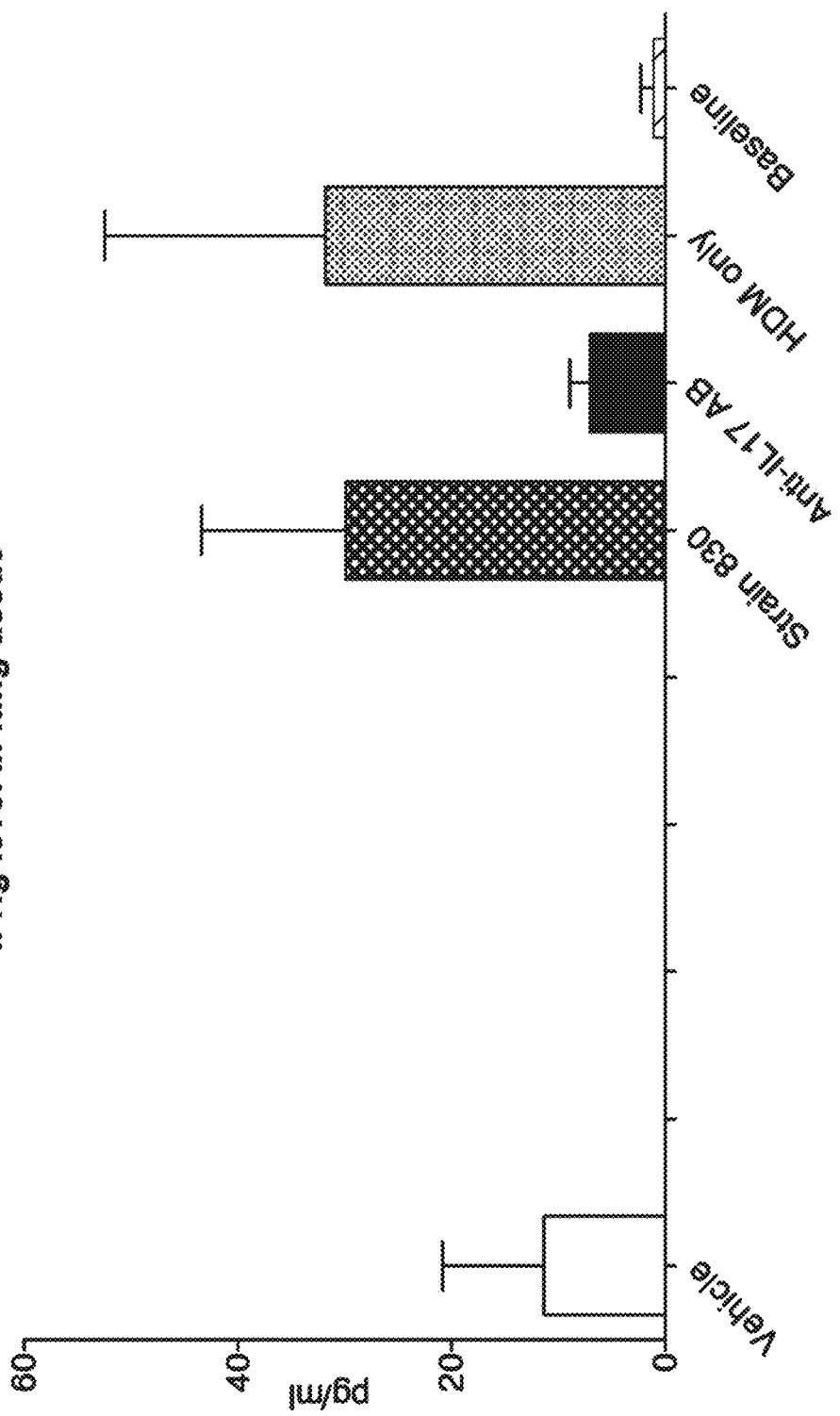
FIG. 55: Mouse model of severe neutrophilic asthma—IFNγ level in lung tissue
Figure 56:
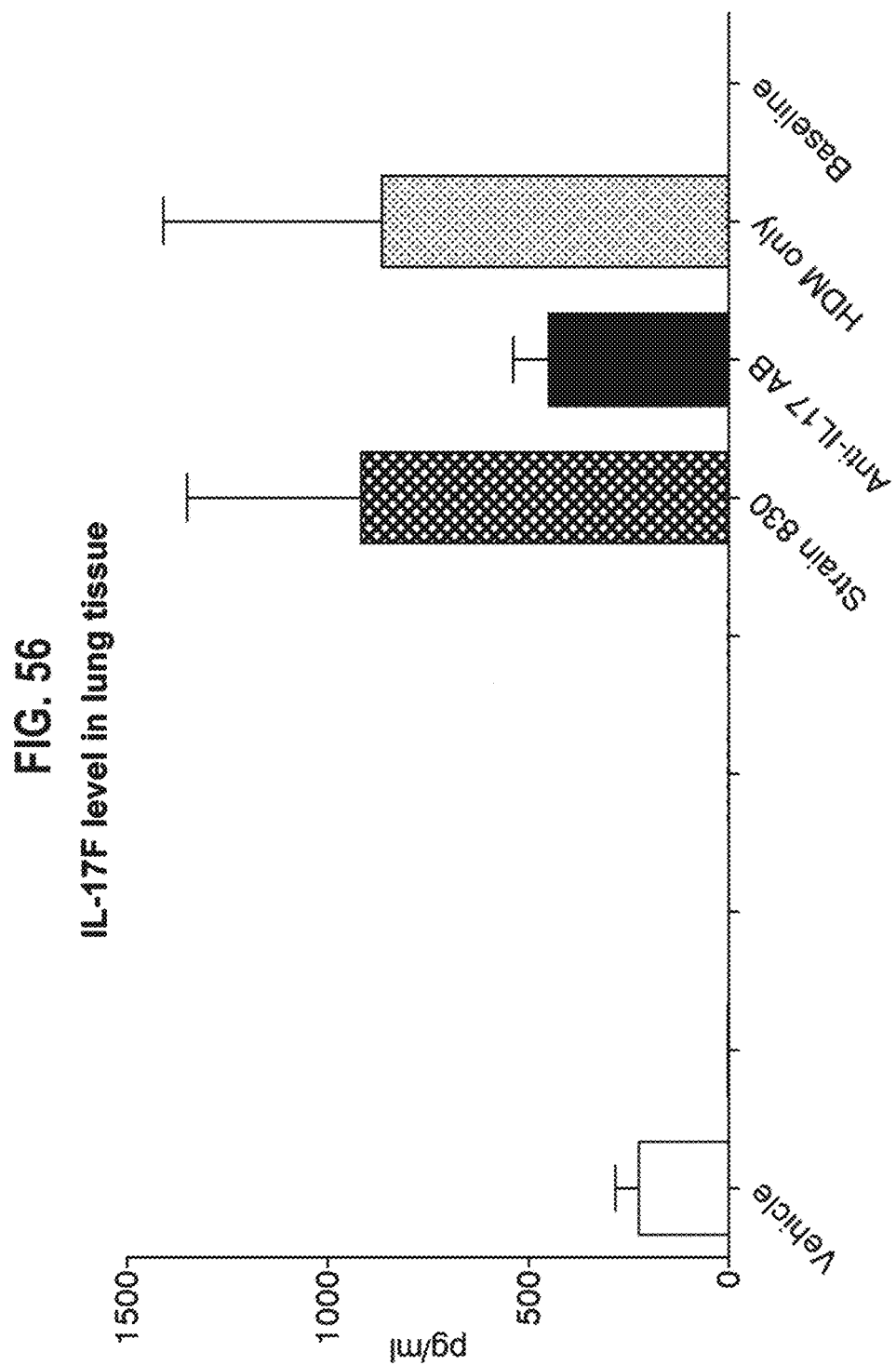
FIG. 56: Mouse model of severe neutrophilic asthma—IL-17F level in lung tissue
Figure 57:
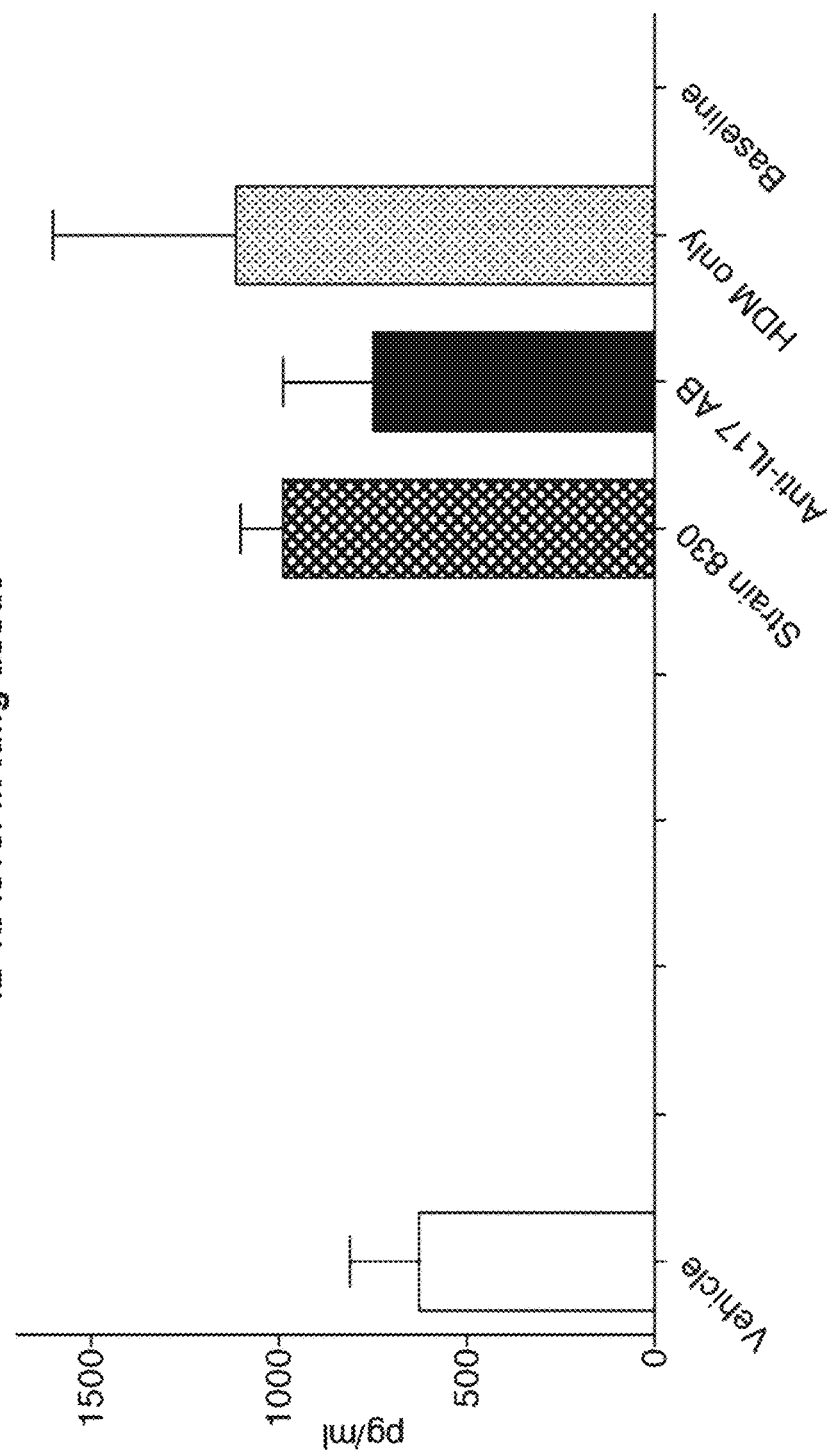
FIG. 57: Mouse model of severe neutrophilic asthma—IL-1b level in lung tissue
Figure 58:
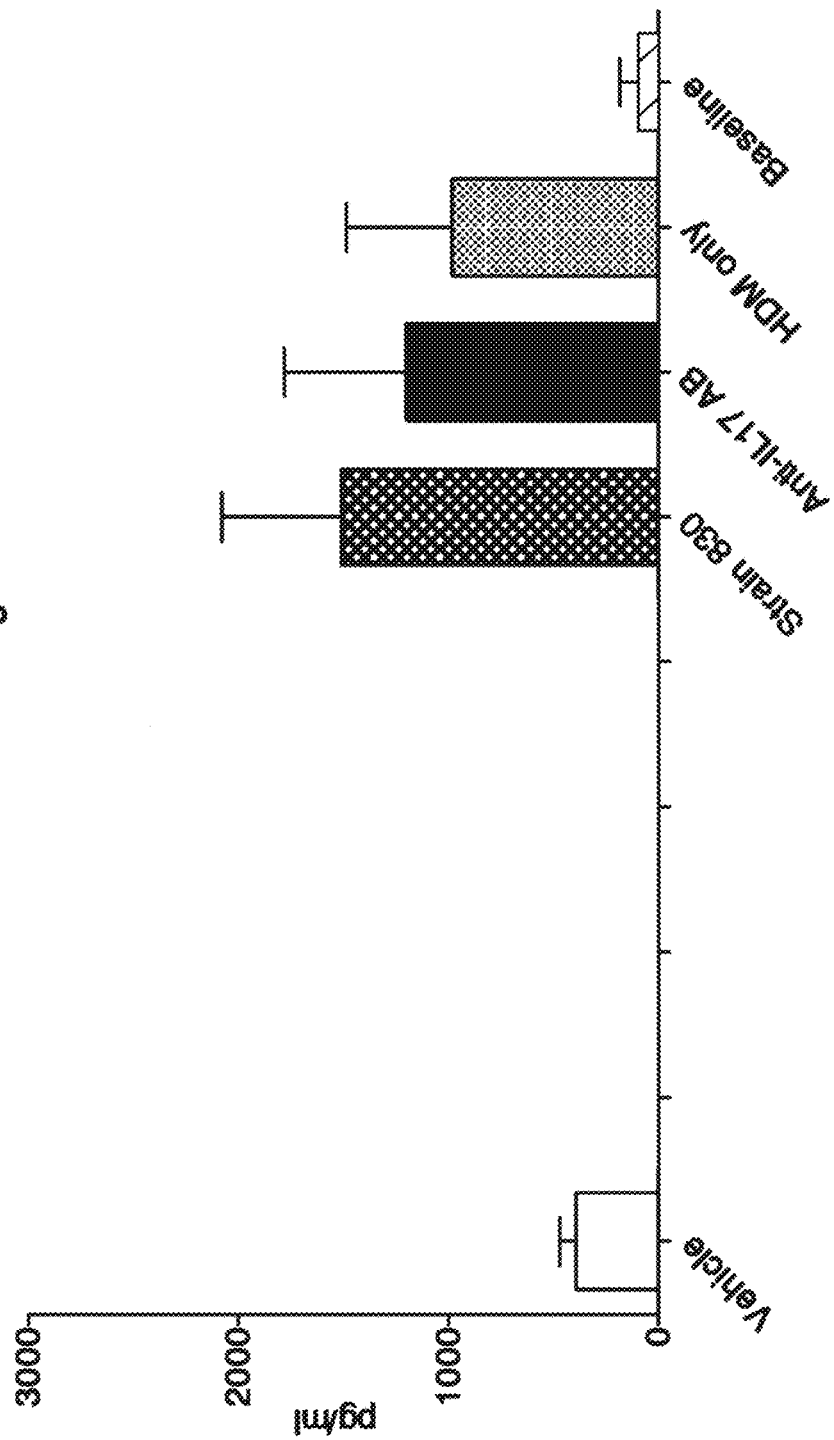
FIG. 58: Mouse model of severe neutrophilic asthma—RANTES level in lung tissue
Figure 59:
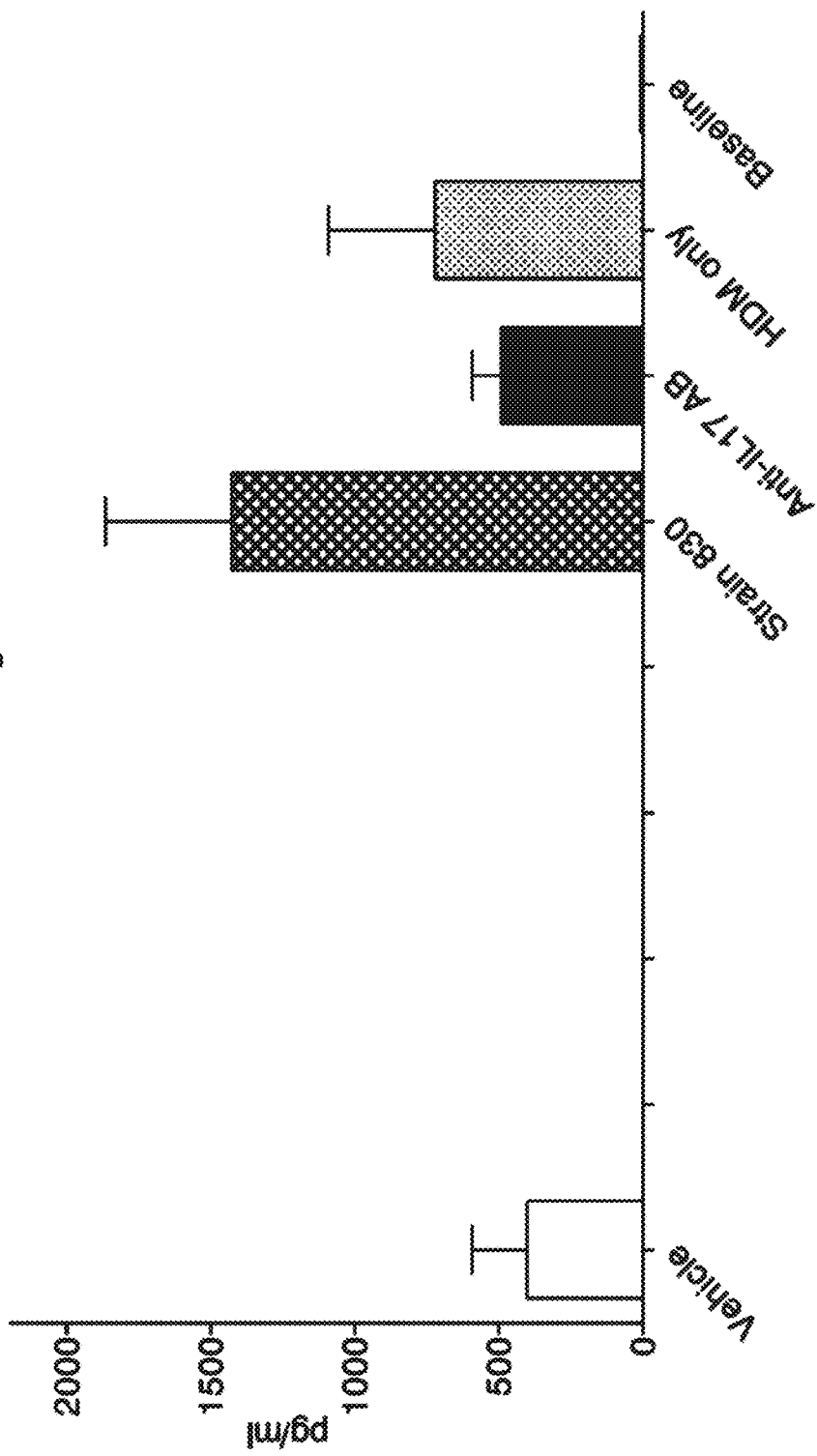
FIG. 59: Mouse model of severe neutrophilic asthma—MIP-2 level in lung tissue
Figure 60:
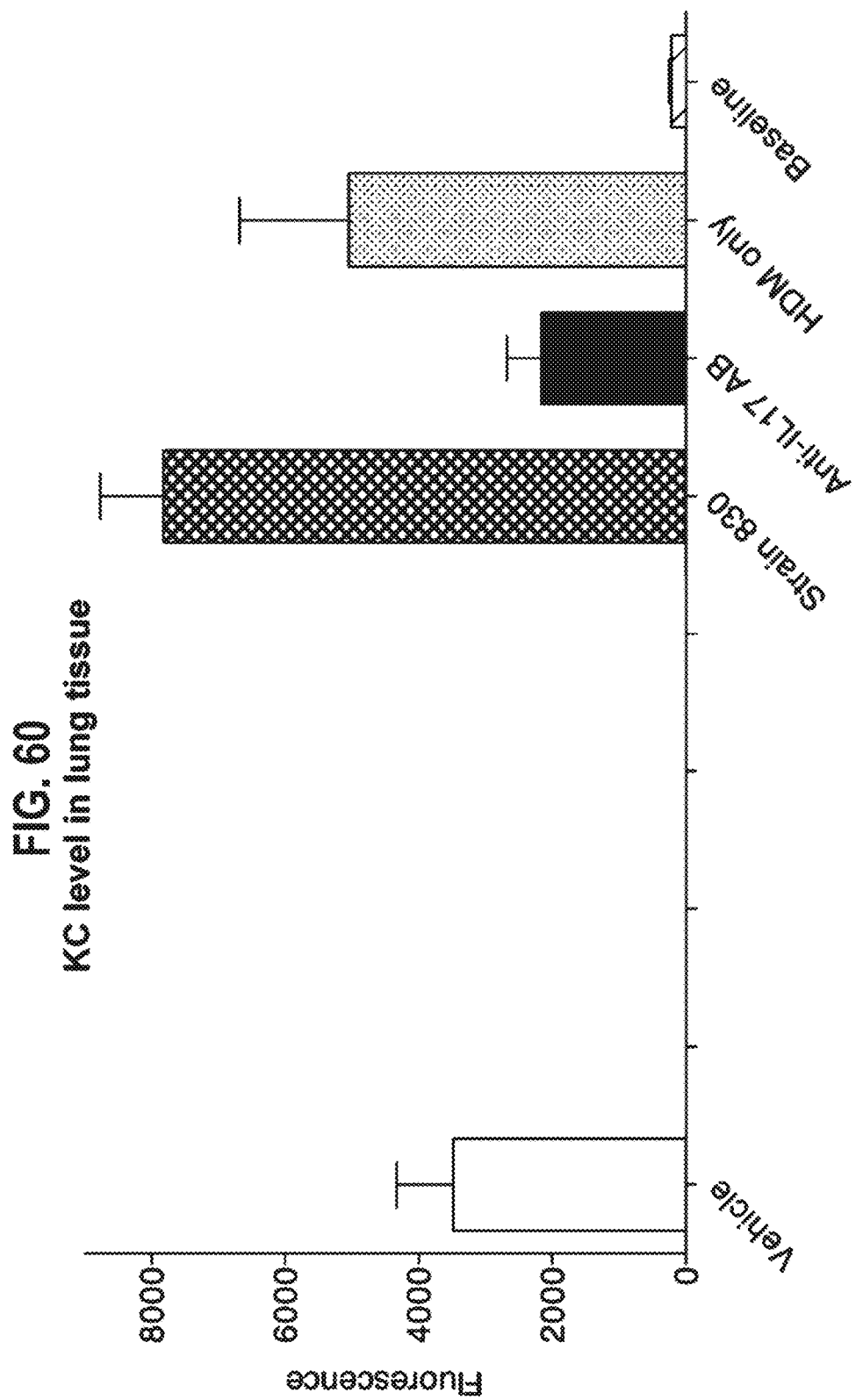
FIG. 60: Mouse model of severe neutrophilic asthma—KC level in lung tissue
Figure 61:
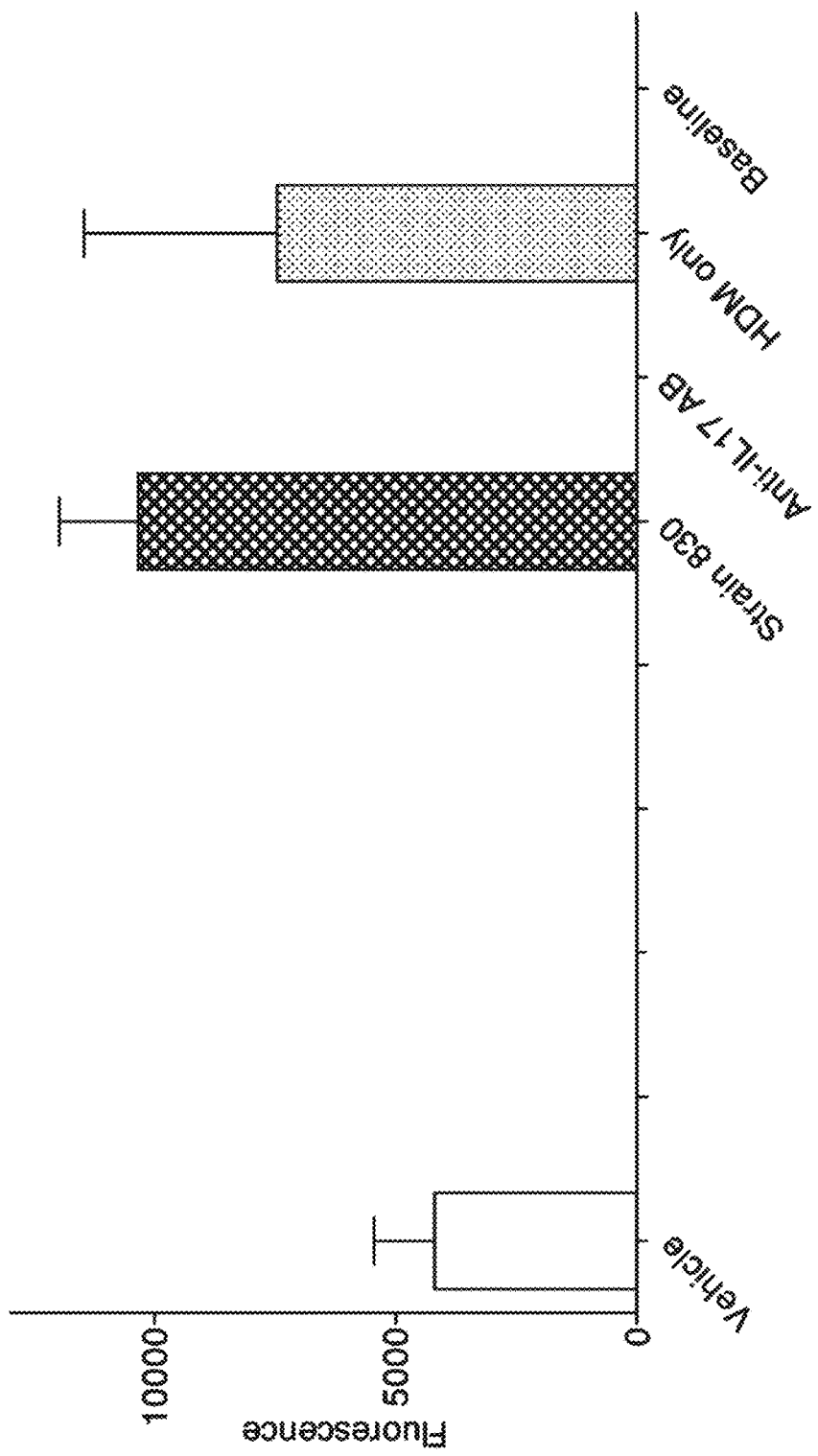
FIG. 61: Mouse model of severe neutrophilic asthma—IL-17A level in lung tissue
Figure 62:
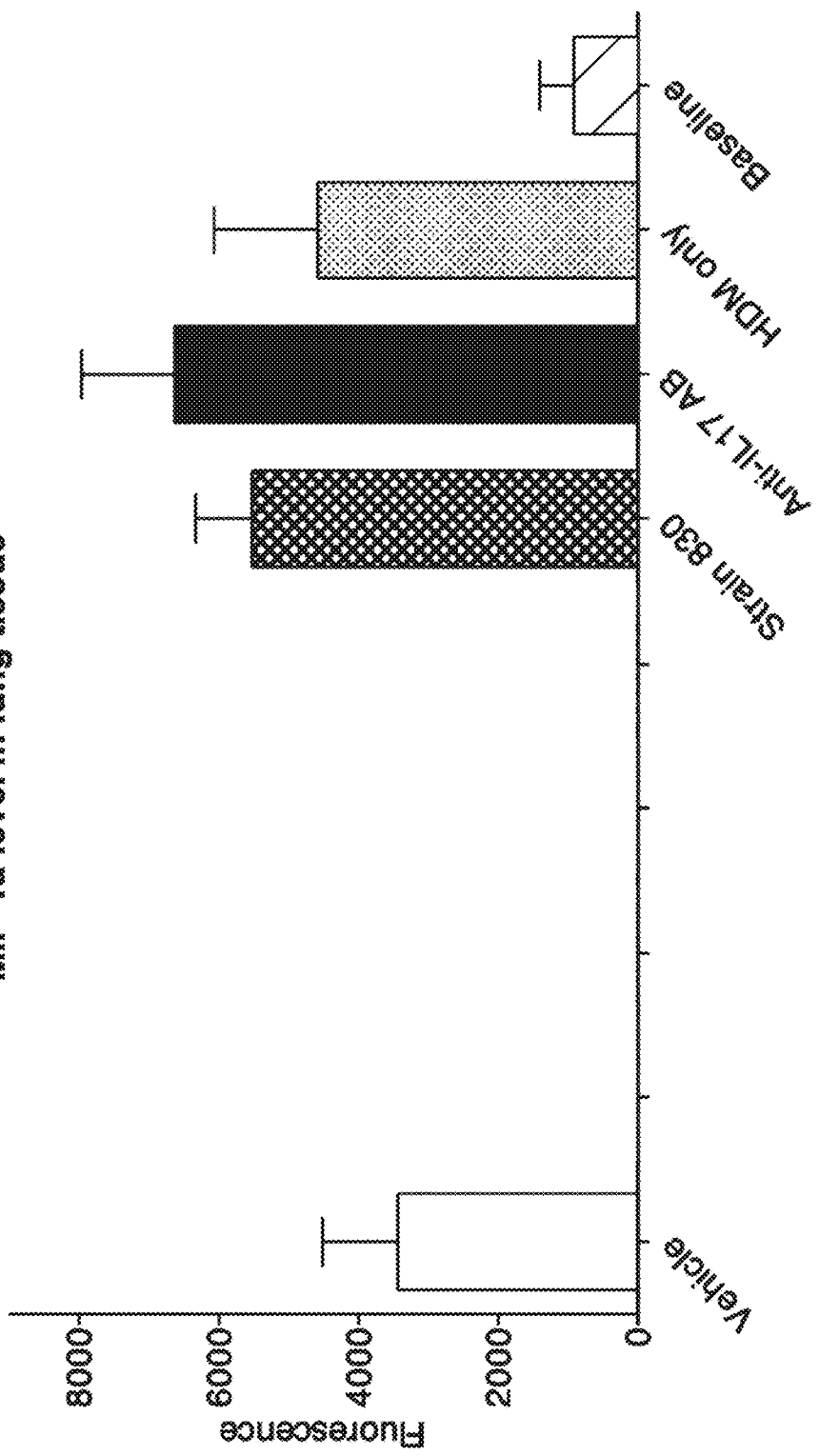
FIG. 62: Mouse model of severe neutrophilic asthma—MIP-1a level in lung tissue
Figure 63:
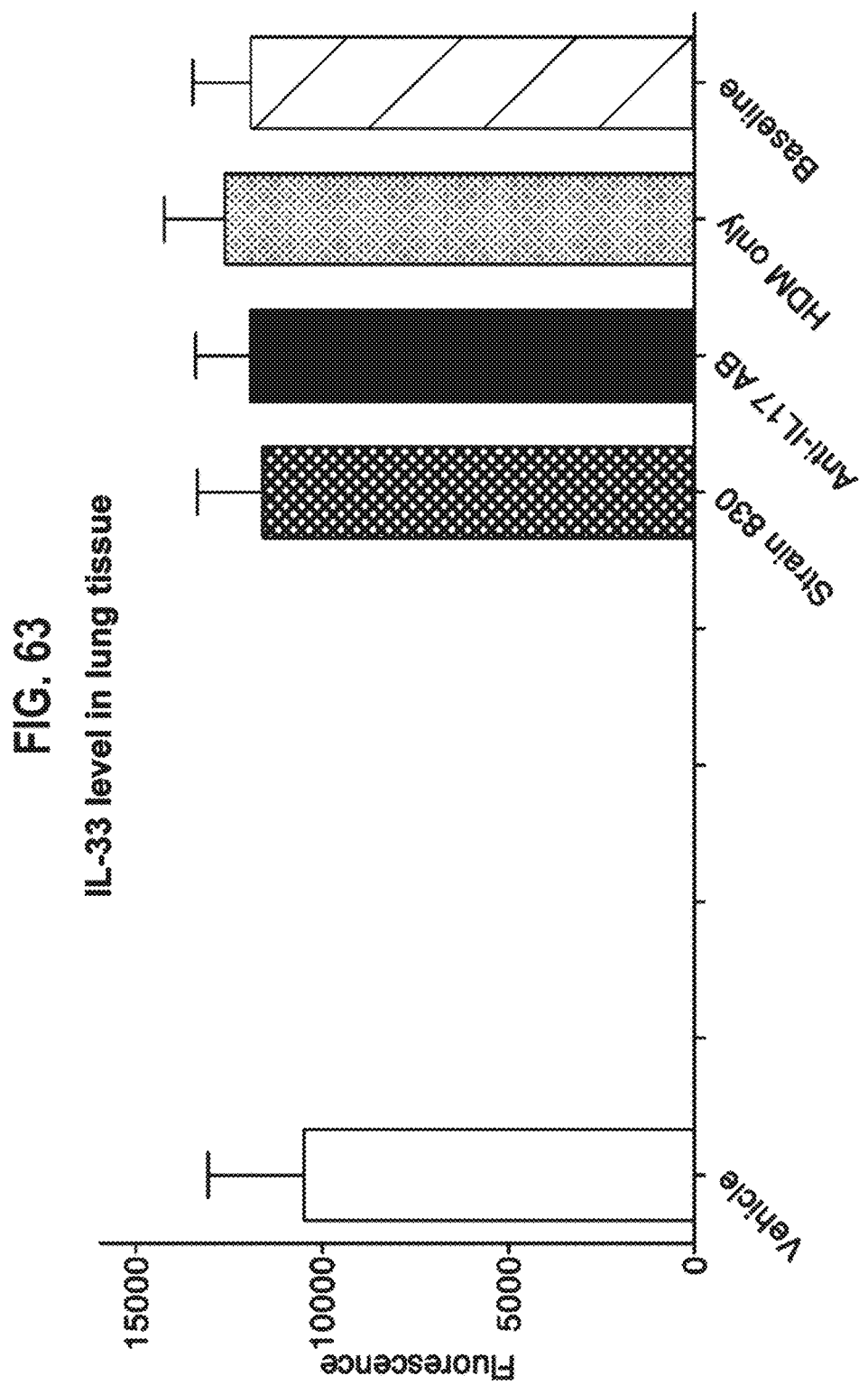
FIG. 63: Mouse model of severe neutrophilic asthma—IL-33 level in lung tissue
Figure 65:
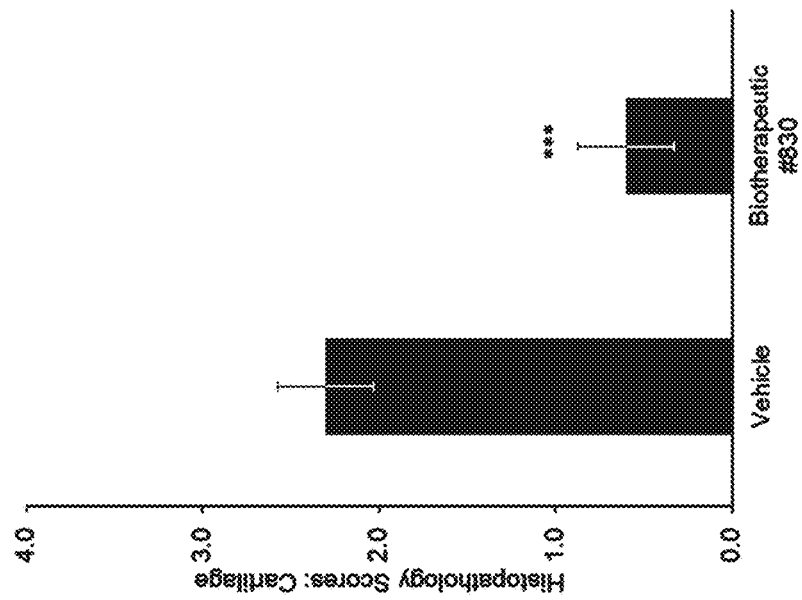
FIG. 65: Mouse model of rheumatoid arthritis—Histopathology: Inflammation Scores. Data are presented as Mean±SEM. **$p<0.01$ when compared to the vehicle-treated group.
Figure 66:
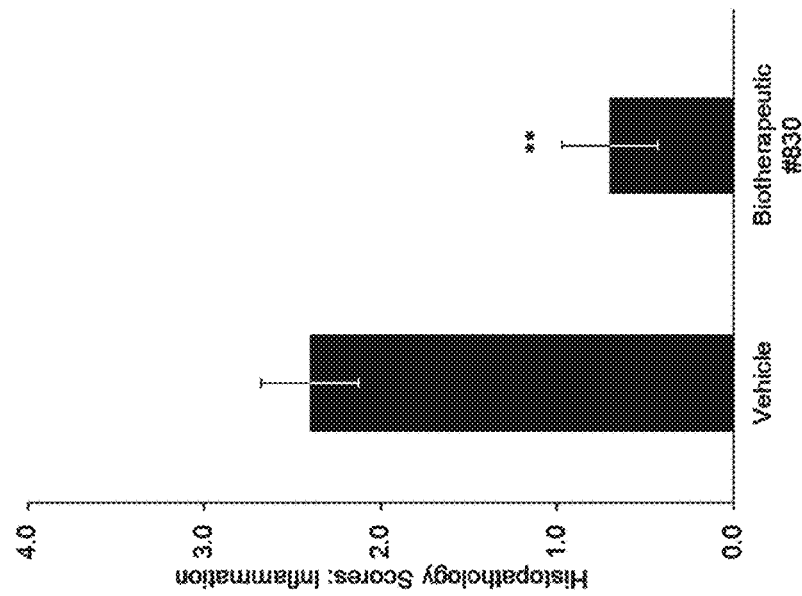
FIG. 66: Mouse model of rheumatoid arthritis—Histopathology: Cartilage Scores. Data are presented as Mean±SEM. ***$p<0.001$ when compared to the vehicle-treated group.
Figure 67:
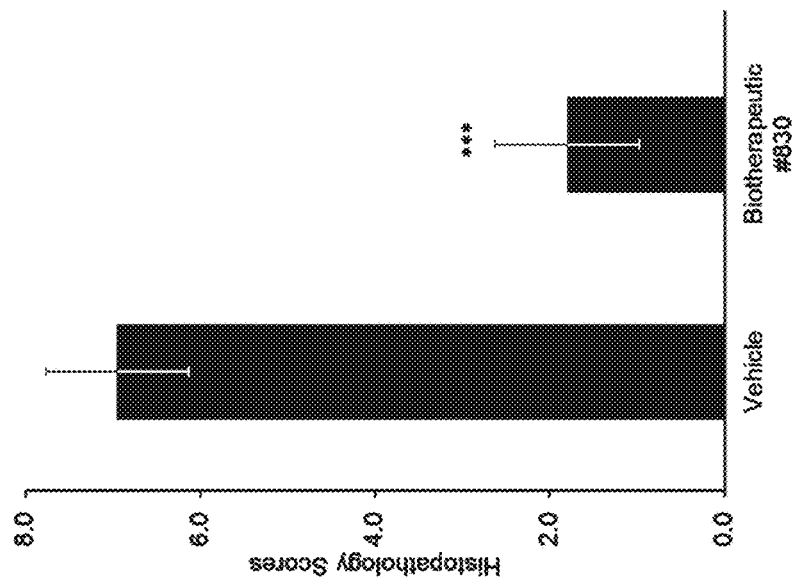
FIG. 67: Mouse model of rheumatoid arthritis—Histopathology: Bone Scores. Data are presented as Mean±SEM. ***$p<0.001$ when compared to the vehicle-treated group.
Figure 68:
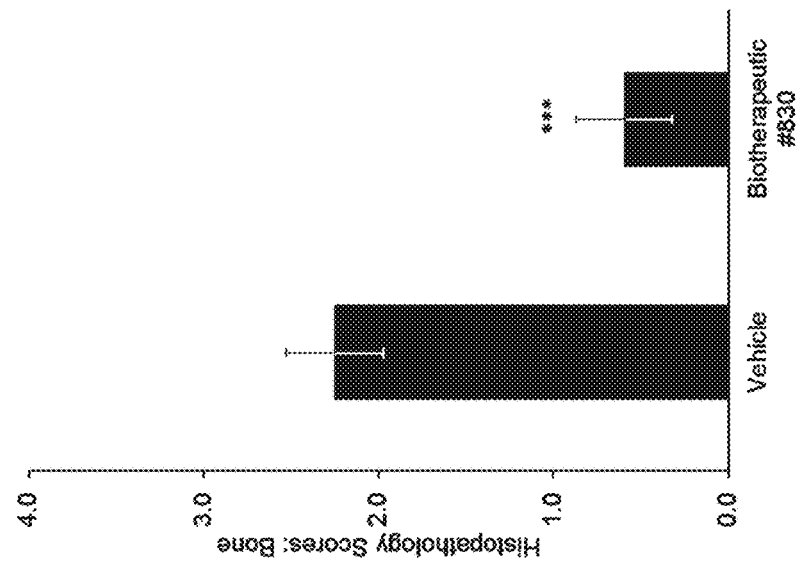
FIG. 68: Mouse model of rheumatoid arthritis—Histopathology: Total Scores. Data are presented as Mean±SEM. ***$p<0.001$ when compared to the vehicle-treated group.

With the above caveats, the data in FIG. 53 suggests that treatment with strain 830 may achieve a reduction in the levels of TNFα, which may be indicative of a mechanism of action related to influences on chemokine release (and thus recruitment of cells) by stromal or innate immune cells. TNFα is part of the Th17 pathway. Taking this dataset together, it can be concluded that strain 830 had a beneficial effect on the inflammation mechanism in this mouse model of severe neutrophilic asthma.

Example 6—Efficacy of Bacterial Inocula in a Mouse Model of Multiple Sclerosis

Summary

Mice were administered with compositions comprising bacterial strains according to the invention and the mice were subsequently immunised with myelin oligodendrocyte glycoprotein to induce experimental autoimmune encephalomyelitis (EAE). EAE is the most commonly used experimental model for human multiple sclerosis. The compositions of the invention were found to have a striking effect on disease incidence and disease severity.

Strain
830: bacteria deposited under accession number NCIMB 43281
Study Design
Groups:
1. Negative control group. Treatment with vehicle control (per oral).
5. Treatment with therapeutic bacteria inoculum strain 830 (per oral).
9. Positive control group. Treatment with Dexamethasone (i.p.).
10. Untreated Control Group.
Number of mice per group=10
Days −14 to day 27: Daily administration of vehicle control per oral (Group 1).
Days −14 to day 27: Daily administration of therapeutic bacteria inoculum per oral (Group 5).
Days 0-28: administration of Dexamethasone (i.p.) three times a week (Group 9)
Day 0: MOG35-55 (myelin oligodendrocyte glycoprotein—2 mg/ml) and CFA (2 mg/ml MTB) were mixed 1:1 resulting in 1 mg/ml solutions. 100 µl of the peptide-CFA mixture was injected subcutaneously into each hind leg. Administration of pertussis toxin intraperitoneally (300 ng).
Day 1: Administration of pertussis toxin intraperitoneally (300 ng).
Days 7-onwards: Measurement of disease incidence and weight three times a week.
Endpoints and Analysis
Mice were analysed for disease incidence and disease severity three times a week. Scoring was performed blind. Disease severity was assessed using a clinical score ranging from 0 to 5, with 5 indicating a dead mouse (see clinical scoring system below).
Monitoring
On the indicated days mice were weighed and observed for disease activity score and disease incidence.
Disease Activity Score Observations:
0—No obvious changes in motor function compared to non-immunized mice.
0.5—Tip of tail is limp.
1.0—Limp tail.
1.5—Limp tail and hind leg inhibition.
2.0—Limp tail and weakness of hind legs.
  OR—There are obvious signs of head tilting when the walk is observed. The balance is poor.
2.5—Limp tail and dragging of hind legs.
  OR—There is a strong head tilt that causes the mouse to occasionally fall over.
3.0—Limp tail and complete paralysis of hind legs.
3.5—Limp tail and complete paralysis of hind legs.
  In addition to: Mouse is moving around the cage, but when placed on its side, is unable to right itself.
  Hind legs are together on one side of body.
4.0—Limp tail, complete hind leg and partial front leg paralysis.
  Mouse is minimally moving around the cage but appears alert and feeding
4.5—Complete hind and partial front leg paralysis, no movement around the cage.
  Mouse is immediately euthanized and removed from cage.
5.0 Mouse is euthanized due to severe paralysis.
When an animal has equal or greater disease activity score of 1, it is considered to have a positive disease incidence score.

Figure 70:
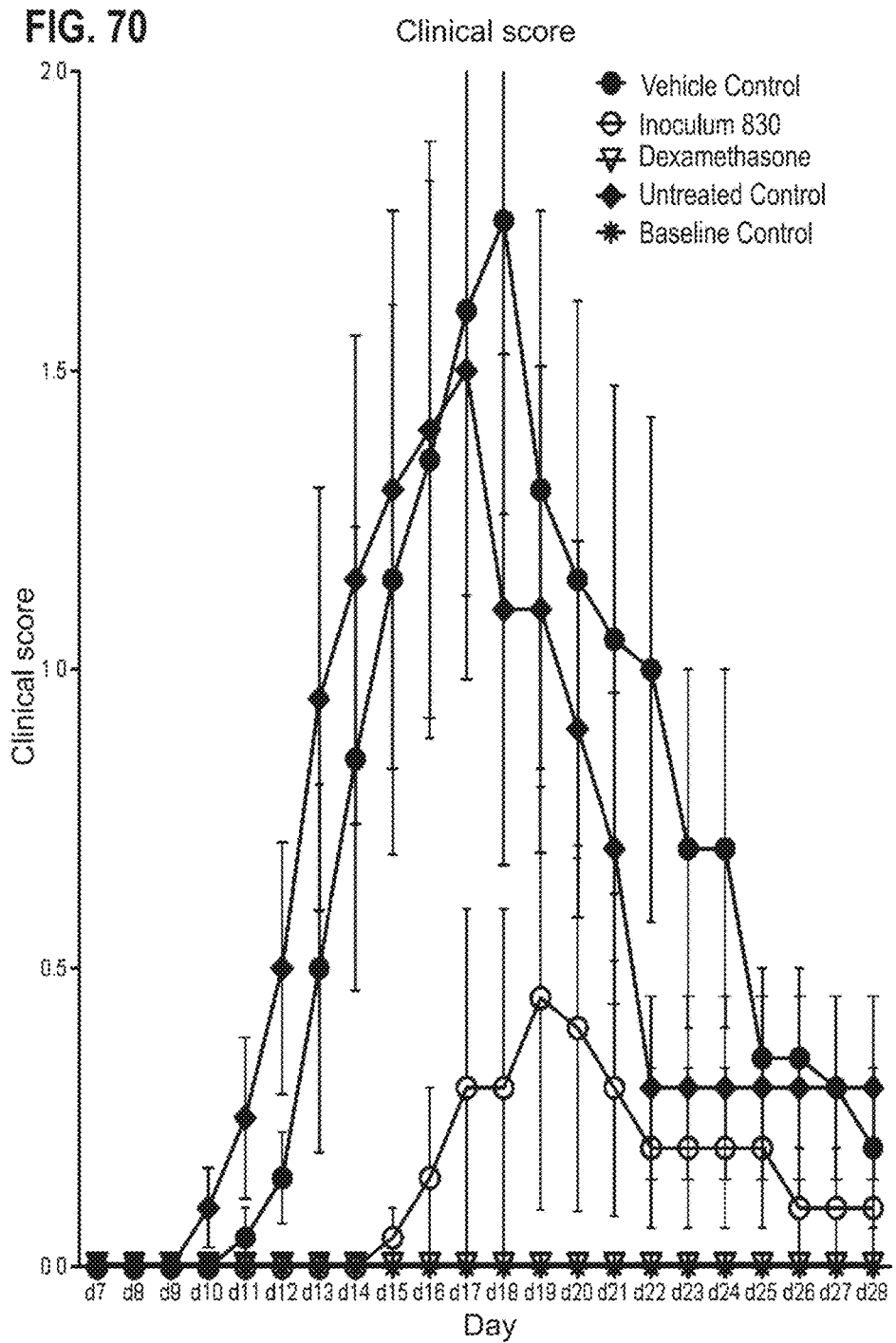
FIG. 70: Mouse model of multiple sclerosis—clinical score.
Figure 71:
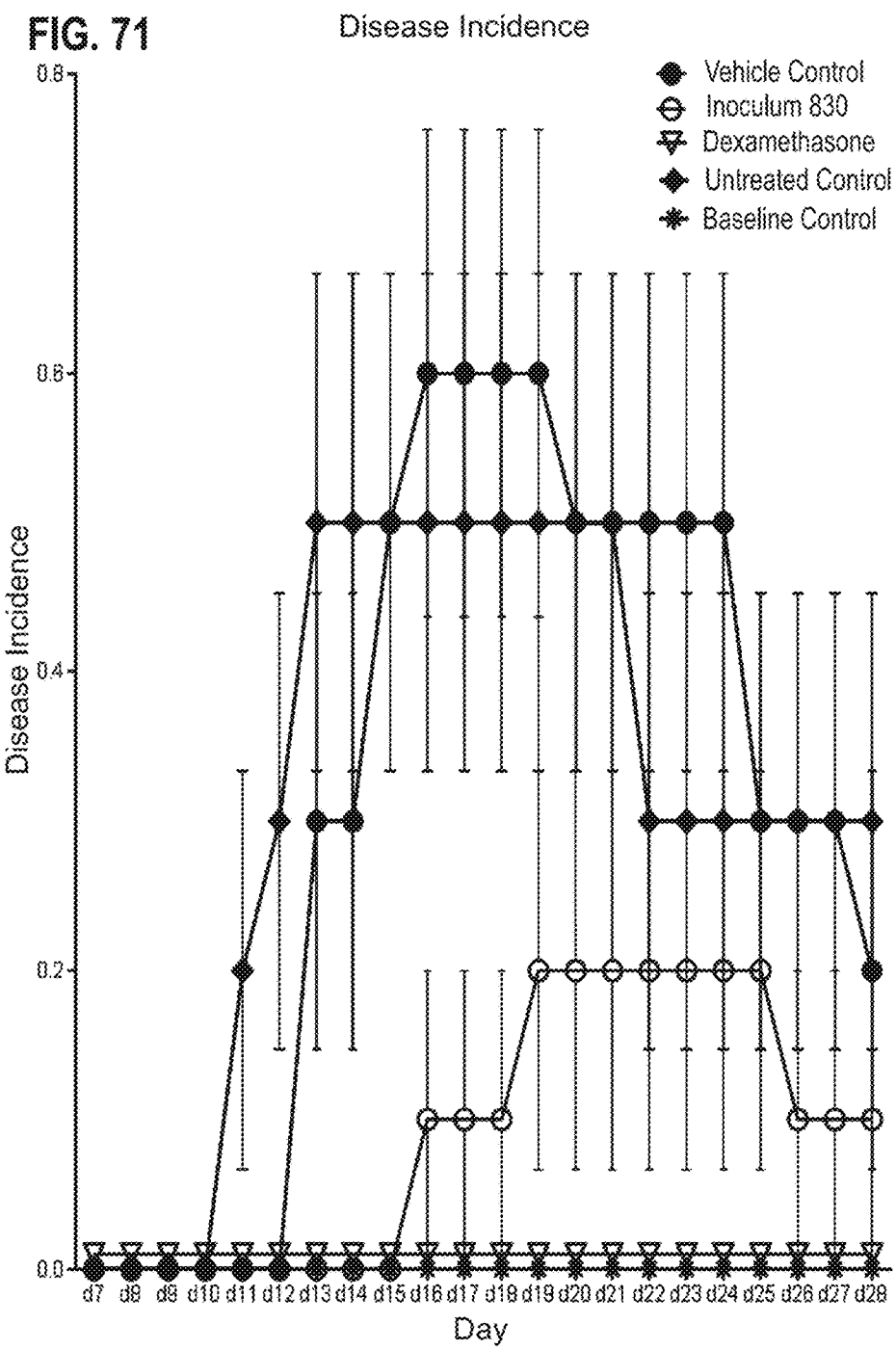
FIG. 71: Mouse model of multiple sclerosis—disease incidence.

Results
The results of the study are shown in FIGS. 70 and 71.
Disease induction in the negative control groups was successful with high scores shown by the vehicle control and the untreated control. The effect of treatment with strain 830 was striking and the mice treated with strain 830 exhibited notably reduced disease incidence and disease severity. Indeed, the reduction in disease incidence and disease severity was comparable to the positive control group. These data indicate the strain 830 may be useful for treating or preventing multiple sclerosis.

Example 7—Efficacy of Bacterial Inocula in a Mouse Model of Uveitis

Summary
This study used a mouse model of interphotoreceptor retinoid-binding protein (IRBP)-induced uveitis to test the effects of bacterial administration on uveitis. Uveitis is a sight-threatening condition resulting from intraocular inflammation and retinal tissue destruction. This disease can be studied in rodents in a model of experimental autoimmune uveoretinitis (EAU) [70]. EAU is an organ-specific disorder where Th1/Th17 cells are directed toward retinal antigens and produce cytokines that activate resident and infiltrating mononuclear cells leading to tissue destruction. EAU can be induced in mice by challenge with retinal antigens including interphotoreceptor retinoid binding protein peptide (IRBPp). Disease onset normally occurs from day 8-9 and peaks after days 14-15. Signs of clinical disease can be monitored using topical endoscopic fundal imaging (TEFI).
Strain
MRX008: *Blautia wexlerae*, bacteria deposited under accession number NCIMB 42486.
Biotherapeutic was provided in glycerol stock. Microbiological growth media (YCFA) was used for the culture of the agent.
Mice
The mice were strain C57BL/6 and were over 6 weeks old at the beginning of the study. 72 mice were used (+36 Satellite animals). Unhealthy animals were excluded from the study. Animals were housed in specific pathogen free (spf) conditions, in a thermostatically monitored holding room (22±4° C.). Animals were allowed to acclimatise under standard animal house conditions for a minimum of one week prior to use. The health status of the animals was monitored throughout this period and the suitability of each animal for experimental use was assessed prior to study start. Mice were housed in groups of up to 10 animals per cage for the duration of the study. Irradiated pellet diet (Lab diet, EU Rodent diet 22%, 5LF5) and water were available ad libitum throughout the acclimatisation and study periods. It is unlikely that any constituent of the diet or water interfered with the study.
Experimental Outline
Adult female C57BL/6 mice were randomly allocated to experimental groups and allowed to acclimatise for one week. Treatments were administered according to the schedule below. On Day 0, animals were administered with an emulsion containing 200 µg of interphotoreceptor retinoid binding protein peptide 1-20 (IRBP p1-20) in complete Freund's adjuvant (CFA) supplemented with 2.5 mg/ml *Mycobacterium Tuberculosis* H37 Ra by subcutaneous injection. Also on Day 0, animals were administered with 1.5 µg *Bordetella Pertussis* toxin by intra-peritoneal injection. From Day −14, animals are weighed three times per week. From Day −1 until the end of the experiment on Day 42, animals are monitored twice per week for clinical signs of uveitis using topical endoscopic fundal imaging (TEFI).
Administration Schedule
All Groups are n=12
Vehicle for oral administration is YCFA medium.
Administration volume for twice daily oral administration is 5 ml/kg.

| Group | Treatment | Dose | Route | Frequency | Disease Induction |
|---|---|---|---|---|---|
| 1 | Vehicle | 5 ml/kg | PO | BID Day-14-End | Day 0: IRBP/CFA, SC Day 0: PTx, IP |
| 2 | MRX008 | 5 ml/kg | | | |

PO: oral administration,
BID: twice daily,
SC: subcutaneous injection,
IP: intra-peritoneal injection,
IRBP: interphotoreceptor binding protein,
CFA: complete Freund's adjuvant,
PTx: Pertussis toxin A positive control group was also tested using treatment with the drug cyclosporin A.
Readouts
Bodyweights.

From Day −14, animals are weighed three times a week. Animals with a bodyweight loss equal to or greater than 15% of their initial (Day 0) bodyweight on two consecutive occasions are culled.
Non-Specific Clinical Observations.

From Day −14 until the end of the experiment, animals are checked daily for non-specific clinical signs to include abnormal posture (hunched), abnormal coat condition (piloerection) and abnormal activity levels (reduced or increased activity).
Clinical Scores: Retinal Imaging by Topical Endoscopic Fundal Imaging (TEFI).

From Day −1 until the end of the experiment, animals are scored twice per week for clinical signs of uveitis. Retinal images are captured using TEFI in non-anaesthetised but restrained animals following pupil dilatation using Tropicamide 1% then Phenylephrine hydrochloride 2.5%. Retinal images are scores using the following system. The maximum cumulative score is 20.

Figure 72:
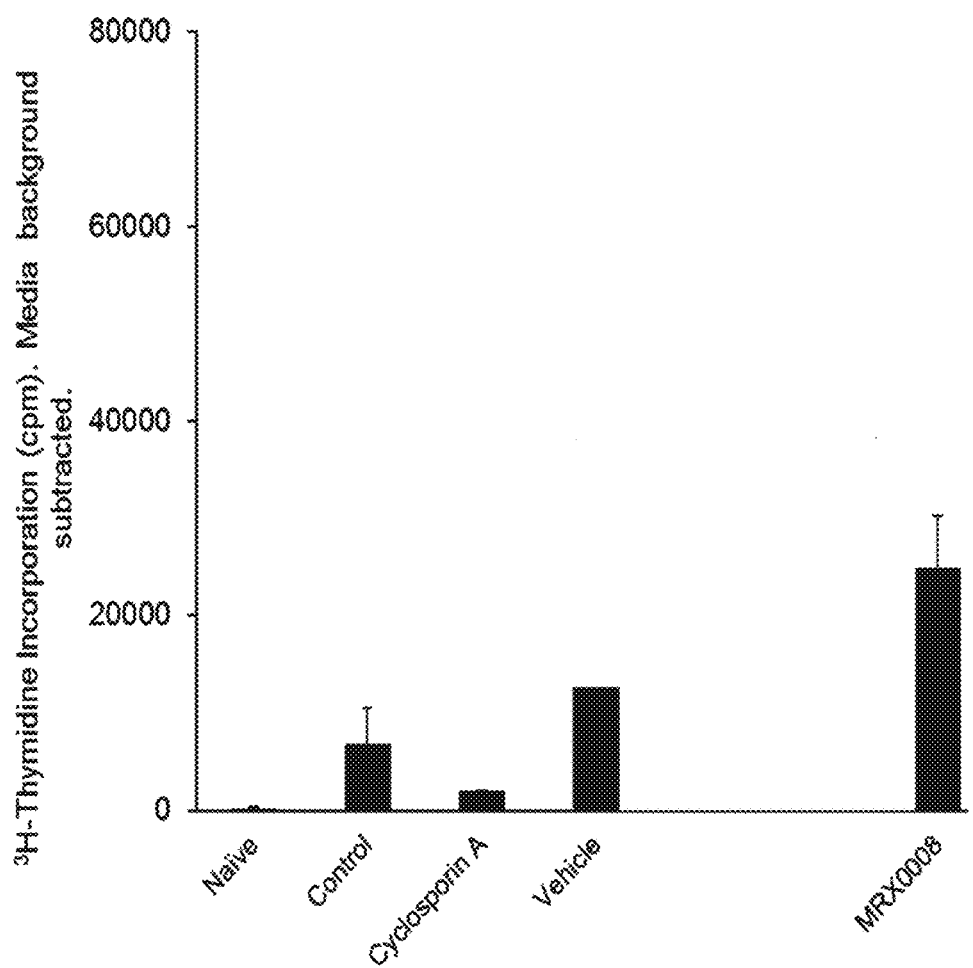
FIG. 72: Mouse model of uveitis—Lymph node proliferative response to IRBP peptide. Media background subtracted [IRBP peptide stimulated—media background] counts per minute based on 3H-thymidine incorporation. All data are presented as Mean+SEM (n=3).
Figure 73:
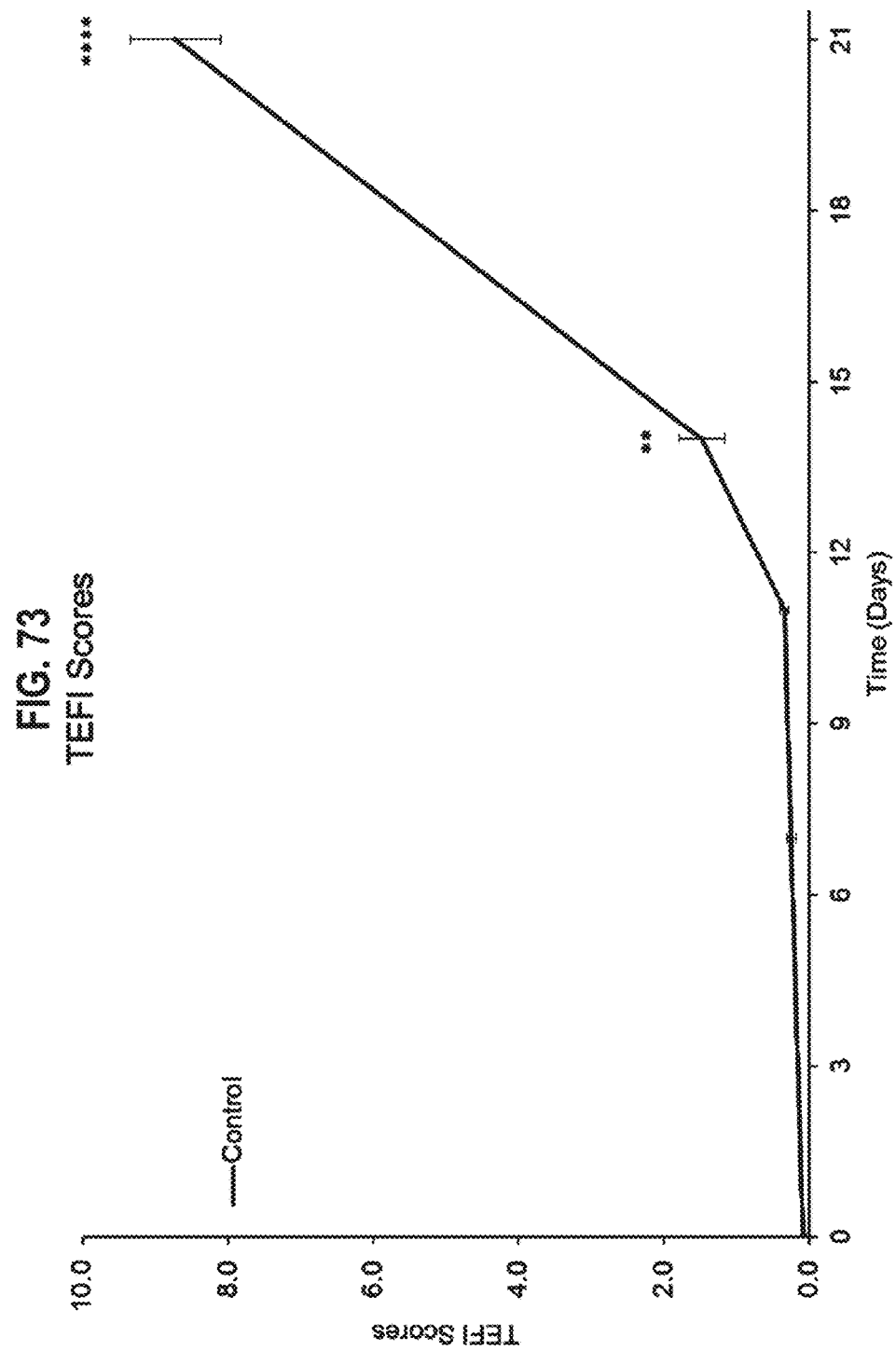
FIG. 73: Mouse model of uveitis—TEFI Scores in the control group. Data are presented as Mean±SEM.
Figure 74:
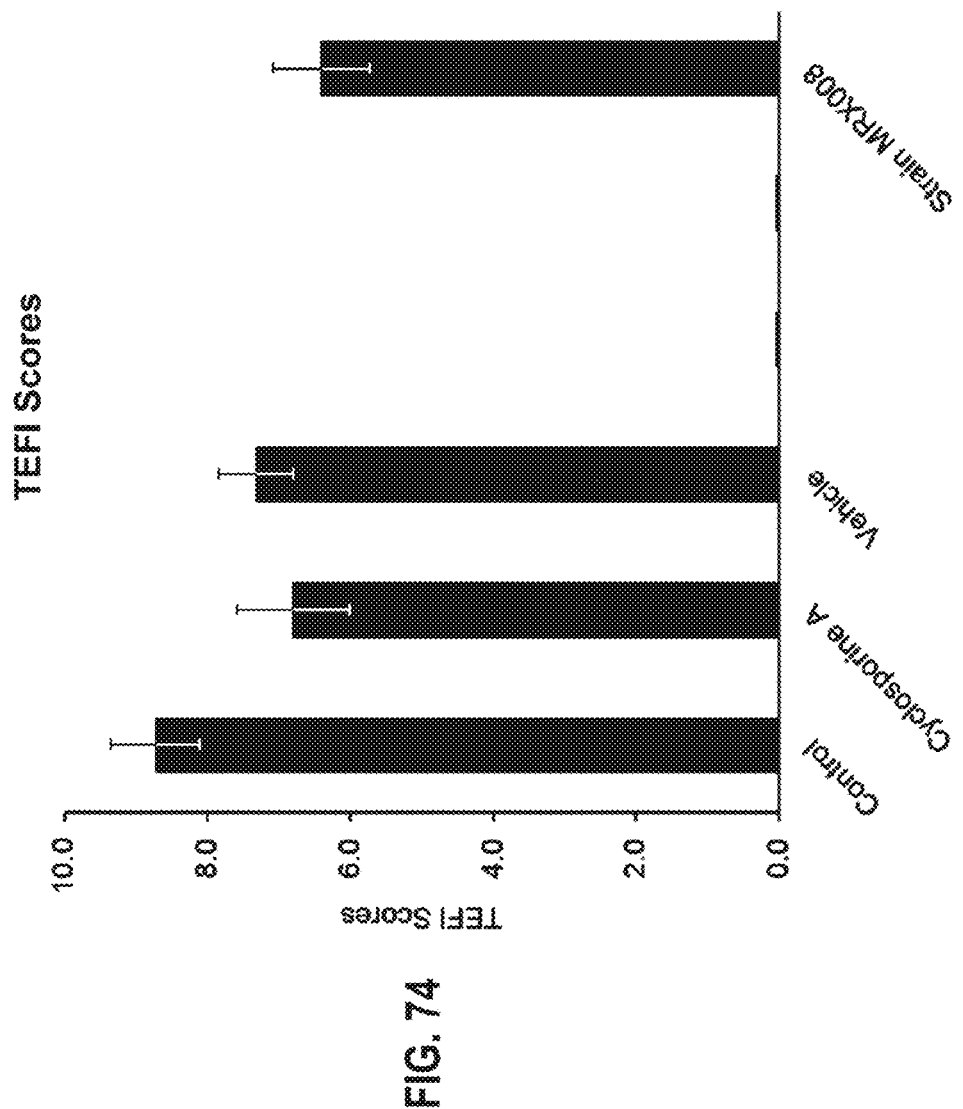
FIG. 74: Mouse model of uveitis—TEFI Scores on Day 21. Data are presented as Mean±SEM.

Results
The results of the study are shown in FIGS. 72-74.
Cell Proliferation (Satellite Animals, Day 21).

Draining lymph nodes (DLN) were removed and cells were isolated. After counting, cells were cultured for 72 h in the presence or absence of IRBP peptide. Supernatants for cytokine analysis were removed prior to pulsing with 3H-Thymidine. Cells were then cultured for a further 18 h prior to harvesting and determination of proliferation by incorporation of 3H-thymidine using a beta-counter.

The groups showed cell proliferation to IRBP stimulus above that seen in the media control wells (these background values were subtracted from the IRBP result to provide data as $\Delta$cpm). Both groups gave strong proliferative responses to a positive control stimulus (anti-CD3/CD28) showing cells in culture were viable and able to proliferate (data not shown).

Proliferative responses to IRBP peptide were analysed by one-way ANOVA followed by Dunnett's post-test for comparison of stimulated responses in the experimental group with the control group.

Proliferative responses to IRBP peptide in disease control animals were of the magnitude expected for this model. The positive control drug, Cyclosporin A, reduced proliferation, although this reduction did not achieve statistical significance (FIG. 72).

The treatment groups (including vehicle alone) showed non-significantly increased proliferation above that seen in control animals.

Proliferative responses to IRBP peptide were analysed by one-way ANOVA followed by Dunnett's post-test for comparison of stimulated responses in treatment groups with the vehicle group. No statistical differences were seen.
Clinical Scores: Retinal Imaging by Topical Endoscopic Fundal Imaging (TEFI).

TEFI scores data measured in the Control group from Day 0 until Day 21 were analysed by Kruskal-Wallis test for non-parametric data followed by Dunn's post-test for multiple comparisons between experimental days.

IRBP administration induced a significant increase in the TEFI scores measured from Day 14 ($p<0.01$) and on Day 21 ($p<0.0001$) when compared to Day 0 in the Control group (FIG. 73).

| Score | Optic disc Inflammation | Retinal vessels | Retinal tissue Infiltration | Structural damage |
|---|---|---|---|---|
| 1 | Minimal | 1-4 mild cuffings | 1-4 small lesions or 1 linear lesion | Retinal lesions or atrophy involving ¼ to ¾ of retinal area |
| 2 | Mild | >4 mild cuffings or 1-3 moderate cuffings | 5-10 small lesions or 2-3 linear lesions | Panretinal atrophy with multiple small lesions (scars) or ≤3 linear lesions (scars) |
| 3 | Moderate | >3 moderate cuffings | >10 small lesions or >3 linear lesions | Panretinal atrophy with >3 linear lesions or confluent lesions (scars) |
| 4 | Severe | >1 severe cuffings | Linear lesion confluent | Retinal detachment with folding |
| 5 | | Not visible (white-out or severe detachment) | | |

TEFI scores data measured in all experimental groups on Day 21 were analysed by Kruskal-Wallis test for non-parametric data followed by Dunn's post-test for multiple comparisons between experimental groups.

At this stage in the experiment, there was no significant difference between experimental groups, but TEFI scores were lower in the MRX008 treated group than in the negative control groups. Indeed, TEFI scores were lower in the MRX008 treated group than in the positive control, cyclosporin A treated group.

Conclusions

Proliferative responses to IRBP peptide were seen in lymph node cultures from all experimental groups, excluding naïve animals, indicating successful disease induction. Clinical scores determined by TEFI increased from Day 14, as expected in this model of IRBP-induced uveitis. By Day 21, significant differences between experimental groups are not yet visible, but a striking reduction in disease incidence and disease severity was observed in the MRX008 treated group, which was a greater reduction than seen for the positive control group. In particular, these data indicate that treatment with the strain MRX008 reduced retinal damage, optic disc inflammation and/or retinal tissue infiltration by inflammatory cells (see TEFI retinal image scoring system above). These data indicate the strain MRX008 may be useful for treating or preventing uveitis.

Example 8—Efficacy of Bacterial Inocula of MRX006 in an LPS-Induced Inflammatory Model—Reduced Cytokine Concentration Summary The bacterial strain MRX006 (830) was tested in an anti-inflammatory assay (n=9) to determine its effect on cytokine concentrations. Inflammation was induced using a well-established trigger of the inflammatory response, lipopolysaccharide (LPS). The magnitude and characteristics of the inflammatory response in the MRX006 (830) treated groups was compared to control groups. The compositions of the invention were found to alleviate the inflammatory response, and in particular to reduce the concentration of the cytokines IL-6 and TNFα. The data therefore indicate that the compositions of the invention have a broad inflammatory phenotype and may be useful for treating inflammatory diseases, such as neutrophilia and asthma.

Results and Analysis

Figure 75:
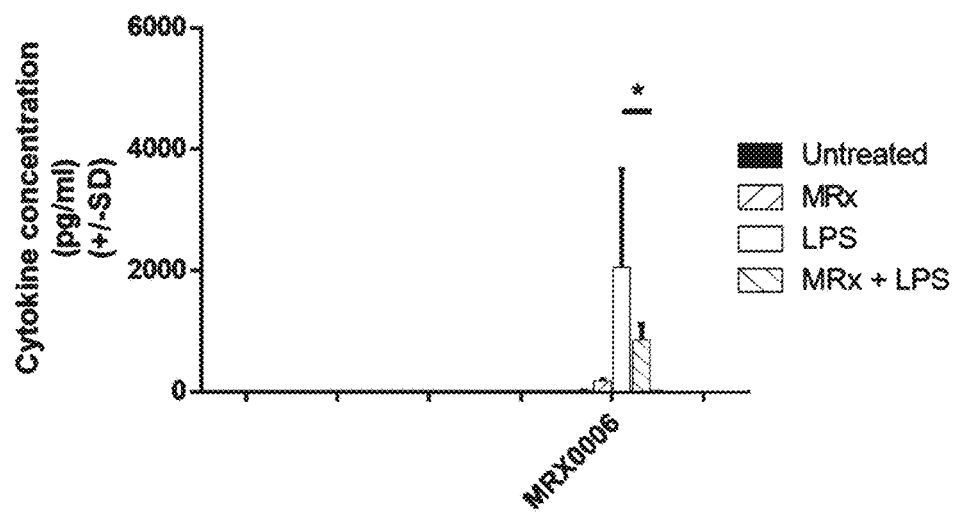
FIG. 75: LPS-induced inflammatory assay—IL-6 levels
Figure 76:
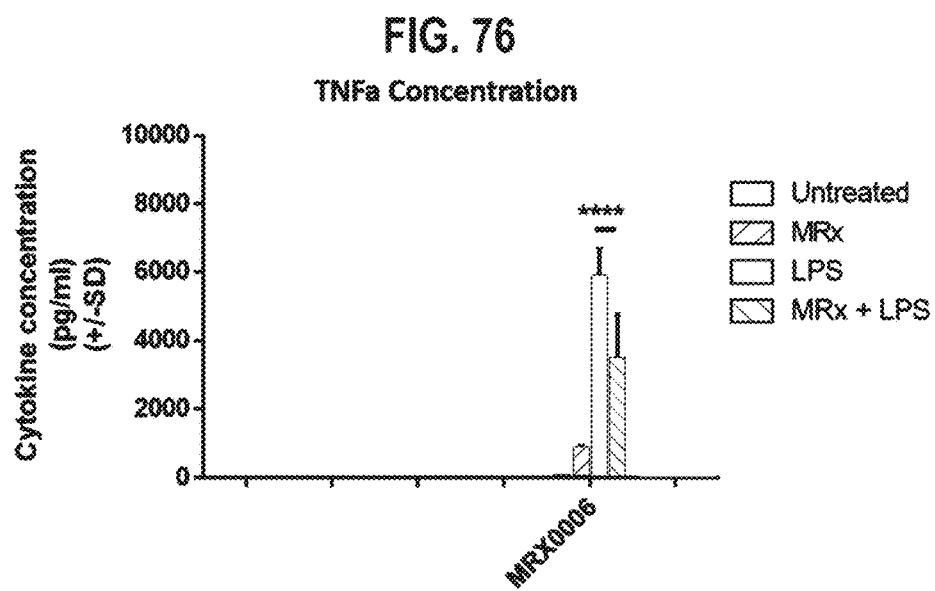
FIG. 76: LPS-induced inflammatory assay—TNF a levels

The results of the experiment are shown in FIGS. 75 and 76.

As shown in FIGS. 75 and 76, respectively, the administration of LPS causes an increase in IL-6 and TNFα levels, as would be expected after induction of inflammation. Importantly, the levels of these cytokines is significantly reduced in the groups treated with MRX006 (830). Therefore, the compositions of the invention reduce the concentration of inflammatory cytokines and therefore have a broad anti-inflammatory phenotype.

Example 9—Efficacy of Bacterial Inocula of MRX006 in an LPS-Induced Inflammatory Model—Reduced Monocyte Derived Dendritic Cells (Mo-DC) Maturation Summary The bacterial strain MRX006 (830) was tested in an anti-inflammatory assay involving the detection of the extent of the maturation of monocyte-derived dendritic cells (Mo-DCs). These cells, particularly the CD1a+CD14− cells as used in this example, are involved in the inflammatory response upon maturation. Maturation of CD1a+CD14− cells is indicated by their increased expression of CD80, CD83, CD86 and HLA-DR. The compositions of the invention were found to alleviate the inflammatory response, and in particular to reduce the maturation of dendritic cells associated with the inflammatory response (CD1a+CD14−). The data therefore indicate that the compositions of the invention may be useful for treating inflammatory diseases, such as neutrophilia and asthma.

Results and Analysis

The results of the experiment are shown in FIG. 77.

As shown in FIG. 77, the administration of LPS causes an increase in the expression of markers of maturation on the MoDCs, as indicated by the shift of the black line to the right of the graph. Importantly, the level of expression of maturation markers is reduced in the LPS group treated with MRX006 (as indicated by the shift of the black filled line to the left). For the LPS+MRX006 group, the level of expression of the CD80, CD83 and HLA-DR inflammatory markers returns to the level of expression in the unstimulated control (dashed line). Additionally, the level of expression of CD86 in the LPS+MRX006 group is also greatly reduced compared to the LPS alone group. Thus, the compositions of the invention reduce the level of maturation of MoDCs associated with inflammation, and therefore have a broad anti-inflammatory phenotype.

Example 10—Efficacy of Bacterial Inocula in a Mouse Model of Ovalbumin-Induced Inflammatory Model—Reduced CD4+ Cell Division Summary The bacterial strain MRX006 (830) was tested in an additional inflammatory assay (n=5) involving the detection of the level of CD4+ cells. Increased CD4+ cell levels is an indicator of inflammation. One of the reasons for this is that CD4+ cells are involved in the Th17 and IL-17 inflammatory pathways. Inflammation was induced using a well-established trigger of the inflammatory response, ovalbumin. The compositions of the invention were found to alleviate the inflammatory response, and in particular to reduce the number of CD4+ cells. The data therefore indicate that the compositions of the invention may be useful for treating inflammatory diseases, such as neutrophilia and asthma.

Results and Analysis

Figure 78:
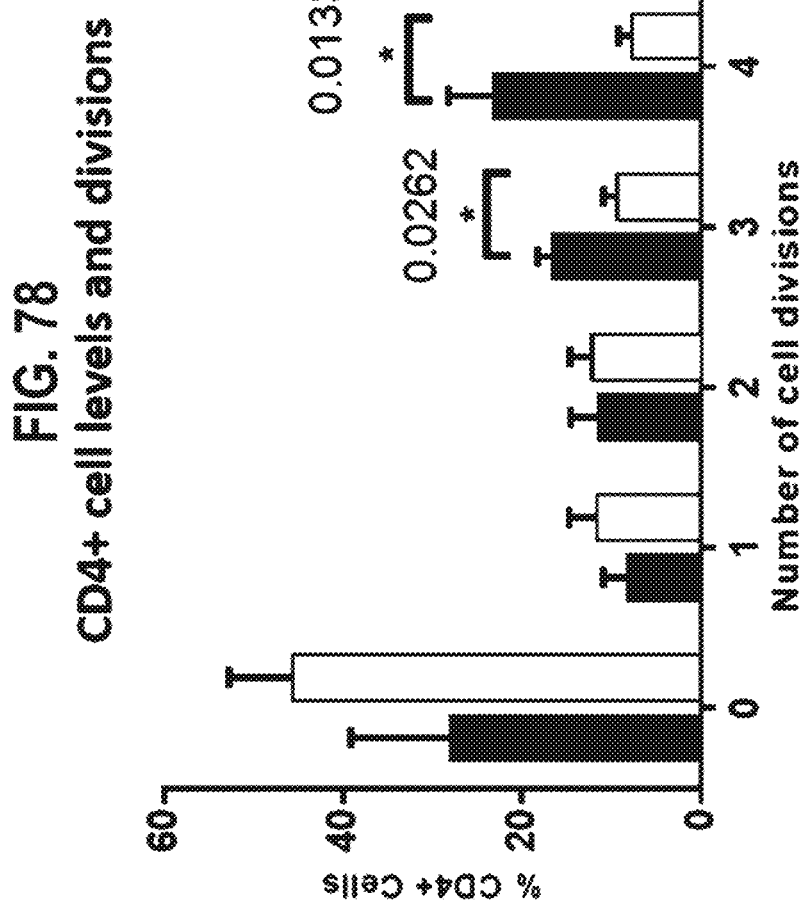
FIG. 78: Ovalbumin-induced inflammatory assay—CD4+ cell levels

The results of the experiment are shown in FIG. 78.

As shown in FIG. 78, the number of CD4+ cells in the population undergoing three or more cell divisions is increased after challenge with ovalbumin (as would be expected upon an inflammatory response). Critically, the number of cells undergoing three or more divisions after challenge with ovalbumin is significantly reduced in groups treated with MRX006. Therefore, the compositions of invention reduce CD4+ cell levels and thus, invention may be useful for treating inflammatory diseases, such as neutrophilia and asthma.

Example 11—Stability Testing

A composition described herein containing at least one bacterial strain described herein is stored in a sealed container at 25° C. or 4° C. and the container is placed in an atmosphere having 30%, 40%, 50%, 60%, 70%, 75%, 80%, 90% or 95% relative humidity. After 1 month, 2 months, 3 months, 6 months, 1 year, 1.5 years, 2 years, 2.5 years or 3 years, at least 50%, 60%, 70%, 80% or 90% of the bacterial strain shall remain as measured in colony forming units determined by standard protocols.

Sequences

SEQ ID NO: 1 (*Blautia stercoris* strain GAM6-1 16S ribosomal RNA gene, partial sequence-1-HM626177)

```
   1  tgcaagtcga gcgaagcgct tacgacagaa ccttcggggg aagatgtaag ggactgagcg
  61  gcggacgggt gagtaacgcg tgggtaacct gcctcataca gggggataac agttggaaac
 121  ggctgctaat accgcataag cgcacggtat cgcatgatac agtgtgaaaa actccggtgg
 181  tatgagatgg acccgcgtct gattagctag ttggaggggt aacggcccac caaggcgacg
 241  atcagtagcc ggcctgagag ggtgaacggc cacattggga ctgagacacg gcccagactc
 301  ctacggggagg cagcagtggg gaatattgca caatgggggga acccctgatg cagcgacgcc
 361  gcgtgaagga agaagtatct cggtatgtaa acttctatca gcagggaaga aaatgacggt
 421  acctgactaa gaagccccgg ctaactacgt gccagcagcc gcggtaatac gtaggggggca
 481  agcgttatcc ggatttactg ggtgtaaagg gagcgtagac ggaagagcaa gtctgatgtg
 541  aaaggctggg gcttaacccc aggactgcat tggaaactgt ttttcttgag tgccggagag
 601  gtaagcggaa ttcctagtgt agcggtgaaa tgcgtagata ttaggaggaa caccagtggc
 661  gaaggcggct tactggacgg taactgacgt tgaggctcga aagcgtgggg agcaaacagg
 721  attagatacc ctggtagtcc acgccgtaaa cgatgaatac taggtgttgg ggagcaaagc
 781  tcttcggtgc cgcagcaaac gcaataagta ttccacctgg ggagtacgtt cgcaagaatg
 841  aaactcaaag gaattgacgg ggacccgcac aagcggtgga gcatgtggtt taattcgaag
 901  caacgcgaag aaccttacca agtcttgaca tcgatctgac cggttcgtaa tggaaccttt
 961  ccttcgggac agagaagaca ggtggtgcat ggttgtcgtc agctcgtgtc gtgagatgtt
1021  gggttaagtc ccgcaacgag cgcaaccccct atcctcagta gccagcaggt gaagctgggc
1081  actctgtgga gactgccagg gataacctgg aggaaggcgg ggacgacgtc aaatcatcat
1141  gccccttatg atttgggcta cacacgtgct acaatggcgt aaacaagggg aagcgagccc
1201  gcgaggggga gcaaatccca aaaataacgt cccagttcgg actgcagtct gcaactcgac
1261  tgcacgaagc tggaatcgct agtaatcgcg aatcagaatg tcgcggtgaa tacgttcccg
1321  ggtcttgtac acaccgcccg tcacaccatg ggagtcagta acgcccgaag tc
```

SEQ ID NO: 2 (consensus 16S rRNA sequence for *Blautia stercoris* strain 830)
TTTKGTCTGGCTCAGGATGAACGCTGGCGGCGTGCTTAACACATGCAAGTCGAGCGAAGCGCTTACGACAGAACCTT
CGGGGGAAGATGTAAGGGACTGAGCGGCGGACGGGTGAGTAACGCGTGGGTAACCTGCCTCATACAGGGGGATAACA
GTTGGAAACGGCTGCTAATACCGCATAAGCGCACAGTATCGCATGATACAGTGTGAAAAACTCCGGTGGTATGAGAT
GGACCCGCGTCTGATTAGCTAGTTGGAGGGGTAACGGCCCACCAAGGCGACGATCAGTAGCCGGCCTGAGAGGGTGA
ACGGCCACATTGGGACTGAGACACGGCCCAGACTCCTACGGGAGGCAGCAGTGGGGAATATTGCACAATGGGGGAAA
CCCTGATGCAGCGACGCCGCGTGAAGGAAGAAGTATCTCGGTATGTAAACTTCTATCAGCAGGGAAGAAATGACGG
TACCTGACTAAGAAGCCCCGGCTAACTACGTGCCAGCAGCCGCGGTAATACGTAGGGGGCAAGCGTTATCCGGATTT
ACTGGGTGTAAAGGGAGCGTAGACGGAAGAGCAAGTCTGATGTGAAAGGCTGGGGCTTAACCCCAGGACTGCATTGG
AAACTGTTTTTCTTGAGTGCCGGAGAGGTAAGCGGAATTCCTAGTGTAGCGGTGAAATGCGTAGATATTAGGAGGAA
CACCAGTGGCGAAGGCGGCTTACTGGACGGTAACTGACGTTGAGGCTCGAAAGCGTGGGGAGCAAACAGGATTAGAT
ACCCTGGTAGTCCACGCCGTAAACGATGAATACTAGGTGTTGGGGAGCAAAGCTCTTCGGTGCCGCAGCAAACGCAA
TAAGTATTCCACCTGGGGAGTACGTTCGCAAGAATGAAACTCAAAGGAATTGACGGGGACCCGCACAAGCGGTGGAG
CATGTGGTTTATTCGAAGCAACGCGAAGAACCTTACCAAGTCTTGACATCGATCTGACCGGTTCGTAATGGAACCTT
TCCTTCGGGACAGAGAAGACAGGTGGTGCATGGTTGTCGTCAGCTCGTGTCGTGAGATGTTGGGTTAAGTCCCGCAA
CGAGCGCAACCCCTATCGTCAGTAGCCAGCAGGTAAAGCTGGGCACTCTGAGGAGACTGCCAGGGATAACCTGGAGG
AAGGCGGGGACGACGTCAAATCATCATGCCCCTTATGATTTGGGCTACACACGTGCTACAATGGCGTAAACAAAGGG
AAGCGAGCCCGCGAGGGGGAGCAAATCCCAAAAATAACGTCCCAGTTCGGACTGCAGTCTGCAACTCGACTGCACGA
AGCTGGAATCGCTAGTAATCGCGAATCAGAATGTCGCGGTGAATACGTTCCCGGGTCTTGTACACACCGCCCGTCAC
ACCATGGGAGTCAGTAACGCCCGAAGTCAGTGACCCAACCTTAGGGAGGGAGCTGCCGAAGGCGGGATTGATAACTG
GGGTGAAGTCTAGGGGGT SEQ ID NO: 3 (*Blautia wexlerae* strain WAL 14507 16S ribosomal RNA gene, partial sequence-EF036467)

```
   1  caagtcgaac gggaattant ttattgaaac ttcggtcgat ttaatttaat tctagtggcg
  61  gacgggtgag taacgcgtgg gtaacctgcc ttatacaggg ggataacagt cagaaatggc
 121  tgctaatacc gcataagcgc acagagctgc atggctcagt gtgaaaaact ccggtggtat
 181  aagatggacc cgcgttggat tagcttgttg gtggggtaac ggcccaccaa ggcgacgatc
```

```
241   catagccggc ctgagagggt gaacggccac attgggactg agacacggcc cagactccta
301   cgggaggcag cagtggggaa tattgcacaa tggggggaaac cctgatgcag cgacgccgcg
361   tgaaggaaga agtatctcgg tatgtaaact tctatcagca gggaagatag tgacggtacc
421   tgactaagaa gccccggcta actacgtgcc agcagccgcg gtaatacgta gggggcaagc
481   gttatccgga tttactgggt gtaaagggag cgtagacggt gtggcaagtc tgatgtgaaa
541   ggcatgggct caacctgtgg actgcattgg aaactgtcat acttgagtgc cggaggggta
601   agcggaattc ctagtgtagc ggtgaaatgc gtagatatta ggaggaacac cagtggcgaa
661   ggcggcttac tggacggtaa ctgacgttga ggctcgaaag cgtggggagc aaacaggatt
721   agataccctg gtagtccacg ccgtaaacga tgaataacta ggtgtcgggt ggcaaagcca
781   ttcggtgccg tcgcaaacgc agtaagtatt ccacctgggg agtacgttcg caagaatgaa
841   actcaaagga attgacgggg acccgcacaa gcggtggagc atgtggttta attcgaagca
901   acgcgaagaa ccttaccaag tcttgacatc cgcctgaccg atccttaacc ggatctttcc
961   ttcgggacag gcgagacagg tggtgcatgg ttgtcgtcag ctcgtgtcgt gagatgttgg
1021  gttaagtccc gcaacgagcg caaccccctat cctcagtagc cagcatttaa ggtgggcact
1081  ctggggagac tgccagggat aacctggagg aaggcgggga tgacgtcaaa tcatcatgcc
1141  ccttatgatt tgggctacac acgtgctaca atggcgtaaa caaagggaag cgagattgtg
1201  agatggagca aatcccaaaa ataacgtccc agttcggact gtagtctgca acccgactac
1261  acgaagctgg aatcgctagt aatcgcggat cagaatgccg cggtgaatac gttcccgggt
1321  cttgtacaca ccgcccgtca caccatggga gtcagtaacg cccgaagtca gtgacctaac
1381  tgcaaagaag gagctgccga aggcgggacc gatgactggg gtgaagtcgt aacaaggt
```

SEQ ID NO: 4 (consensus 16S rRNA sequence for *Blautia wexlerae* strain MRX008)
TTCATTGAGACTTCGGTGGATTTAGATTCTATTTCTAGTGGCGGACGGGTGAGTAACGCGTGGGTAACCTGCCTTAT
ACAGGGGGATAACAGTCAGAAATGGCTGCTAATACCGCATAAGCGCACAGAGCTGCATGGCTCAGTGTGAAAAACTC
CGGTGGTATAAGATGGACCCGCGTTGGATTAGCTTGTTGGTGGGGTAACGGCCCACCAAGGCGACGATCCATAGCCG
GCCTGAGAGGGTGAACGGCCACATTGGGACTGAGACACGGCCCAGACTCCTACGGGAGGCAGCAGTGGGGAATATTG
CACAATGGGGGAAACCCTGATGCAGCGACGCCGCGTGAAGGAAGAAGTATCTCGGTATGTAAACTTCTATCAGCAGG
GAAGATAGTGACGGTACCTGACTAAGAAGCCCCGGCTAACTACGTGCCAGCAGCCGCGGTAATACGTAGGGGGCAAG
CGTTATCCGGATTTACTGGGTGTAAAGGGAGCGTAGACGGTGTGGCAAGTCTGATGTGAAAGGCATGGGCTCAACCT
GTGGACTGCATTGGAAACTGTCATACTTGAGTGCCGGAGGGGTAAGCGGAATTCCTAGTGTAGCGGTGAAATGCGTA
GATATTAGGAGGAACACCAGTGGCGAAGGCGGCTTACTGGACGGTAACTGACGTTGAGGCTCGAAAGCGTGGGGAGC
AAACAGGATTAGATACCCTGGTAGTCCACGCCGTAAACGATGAATACTAGGTGTCNGGGGAGCATGGCTCTTCGGTG
CCGTCGCAAACGCAGTAAGTATTCCACCTGGGGAGTACGTTCGCAAGAATGAAACTCAAAGGAATTGACGGGGACCC
GCACAAGCGGTGGAGCATGTGGTTTAATTCGAAGCAACGCGAAGAACCTTACCAAGTCTTGACATCCGCCTGACCGA
TCCTTAACCGGATCTTTCCTTCGGGACAGGCGAGACAGGTGGTGCATGGTTGTCGTCAGCTCGTGTCGTGAGATGTT
GGGTTAAGTCCCGCAACGAGCGCAACCCCTATCCTCAGTAGCCAGCATTTAAGGTGGGCACTCTGGGGAGACTGCCA
GGGATAACCTGGAGGAAGGCGGGGATGACGTCAAATCATCATGCCCCTTATGATTTGGGCTACACACGTGCTACAAT
GGCGTAAACAAAGGGAAGCGAGATCGTGAGATGGAGCAAATCCCAAAAATAACGTCCCAGTTCGGACTGTAGTCTGC
AACCCGACTACACGAAGCTGGAATCGCTAGTAATCGCGGATCAGAATGCCGCGGTGAATACGTTCCCGGGTCTTGTA
CACACCGCCCGTCACACCATGGGAGTCAGTAACGCCCGAAGTCAGTGACCTAACTGCAAAGAAGGAGCTGCCGAA SEQ ID NO: 5 (strain 830 chromosome sequence)-see electronic sequence listing.

SEQ ID NO: 6 (strain 830 plasmid sequence)-see electronic sequence listing.

REFERENCES

[1] Spor et al. (2011) *Nat Rev Microbiol.* 9(4):279-90.
[2] Eckburg et al. (2005) *Science.* 10; 308(5728):1635-8.
[3] Macpherson et al. (2001) *Microbes Infect.* 3(12):1021-35
[4] Macpherson et al. (2002) *Cell Mol Life Sci.* 59(12):2088-96.
[5] Mazmanian et al. (2005) *Cell* 15; 122(1):107-18.
[6] Frank et al. (2007) *PNAS* 104(34):13780-5.
[7] Scanlan et al. (2006) *J Clin Microbiol.* 44(11):3980-8.
[8] Kang et al. (2010) *Inflamm Bowel Dis.* 16(12):2034-42.
[9] Machiels et al. (2013) *Gut.* 63(8):1275-83.
[10] WO 2013/050792
[11] WO 03/046580
[12] WO 2013/008039
[13] WO 2014/167338
[14] Goldin and Gorbach (2008) *Clin Infect Dis.* 46 Suppl 2:S96-100.
[15] Azad et al. (2013) *BMJ.* 347:f6471.

[16] Liu et al. (2008) *Int J Syst Evol Microbiol* 58, 1896-1902.
[17] Park et al. (2012) *Int J Syst Evol Microbiol.* 62(Pt 4):776-9.
[18] Liu et al. (2008) *Int J Syst Evol Microbiol.* 58(Pt 8):1896-902.
[19] Masco et al. (2003) *Systematic and Applied Microbiology,* 26:557-563.
[20] Srůtková et al. (2011) *J. Microbiol. Methods,* 87(1):10-6.
[21] Ye et al. (2015) *PLoS One.* 10(1):e0117704.
[22] Fabro et al. (2015) *Immunobiology.* 220(1):124-35.
[23] Yin et al. (2014) *Immunogenetics.* 66(3):215-8.
[24] Cheluvappa et al. (2014) *Clin Exp Immunol.* 175(2):316-22.
[25] Schieck et al. (2014) *J Allergy Clin Immunol.* 133(3):888-91.
[26] Balato et al. (2014) *J Eur Acad Dermatol Venereol.* 28(8):1016-24.
[27] Monteleone et al. (2011) *BMC Medicine.* 2011, 9:122.
[28] Fahy (2009) *Proc Am Thorac Soc* 6.256-259
[29] Miossec and Kolls (2012) *Nat Rev Drug Discov.* 11(10):763-76.
[30] Yang et al. (2014) *Trends Pharmacol Sci.* 35(10):493-500.
[31] Koenders et al. (2006) *J. Immunol.* 176:6262-6269.
[32] Amedei et al. (2012) *Int J Mol Sci.* 13(10):13438-60.
[33] Shabgah et al. (2014) *Postepy. Dermatol. Alergol.* 31(4):256-61.
[34] Zhang (2015) *Inflammation. August 23.*
[35] Sun et al. (2015) *Cytokine.* 74(1):76-80.
[36] Mucientes et al. (2015) *Br J Ophthalmol.* 99(4):566-70.
[37] Jawad et al. (2013) *Ocul Immunol Inflamm.* 21(6):434-9.
[38] Maya et al. (2014) *J. Ophthalmology.* 310329
[39] Chi et al. (2007) *J. Allergy and Clinical Immunology.* 119(5):1218-1224.
[40] Chi et al. (2008) *Investigative Ophthalmology & Visual Science.* 49(7): 3058-3064.
[41] Luger and Caspi (2008) *Semin. Immunopathol.* 30(2): 134-143.
[42] Numasaki et al. (2003) *Blood.* 101:2620-2627.
[43] Zhang et al. (2008) *Biochem. Biophys. Res. Commun.* 374: 533-537.
[44] Karin (2006) *Nature.* 441: 431-436.
[45] Faghih et al. (2013). *Iranian Journal of Immunology.* 10(4):193-204.
[46] Numasaki et al. (2005) *J. Immunol.* 175: 6177-6189
[47] Hammerich and Tacke (2014) *Clin Exp Gasfroenterol.* 7:297-306.
[48] Miyamoto-Shinohara et al. (2008) *J. Gen. Appl. Microbiol.,* 54, 9-24.
[49] Cryopreservation and Freeze-Drying Protocols, ed. by Day and McLellan, Humana Press.
[50] Leslie et al. (1995) *Appl. Environ. Microbiol.* 61, 3592-3597.
[51] Mitropoulou et al. (2013) *J Nutr Metab.* (2013) 716861.
[52] Kailasapathy et al. (2002) *Curr Issues Intest Microbiol.* 3(2):39-48.
[53] Handbook of Pharmaceutical Excipients, 2nd Edition, (1994), Edited by A Wade and P J Weller
[54] Remington's Pharmaceutical Sciences, Mack Publishing Co. (A. R. Gennaro edit. 1985)
[55] *Handbook of Microbiological Media, Fourth Edition* (2010) Ronald Atlas, CRC Press.
[56] *Maintaining Cultures for Biotechnology and Industry* (1996) Jennie C. Hunter-Cevera, Academic Press
[57] Strobel (2009) *Methods Mol Biol.* 581:247-61.
[58] Gennaro (2000) *Remington: The Science and Practice of Pharmacy.* 20th edition, ISBN: 0683306472.
[59] *Molecular Biology Techniques: An Intensive Laboratory Course,* (Ream et al., eds., 1998, Academic Press).
[60] *Methods In Enzymology* (S. Colowick and N. Kaplan, eds., Academic Press, Inc.)
[61] *Handbook of Experimental Immunology,* Vols. I-IV (D. M. Weir and C. C. Blackwell, eds, 1986, Blackwell Scientific Publications)
[62] Sambrook et al. (2001) *Molecular Cloning: A Laboratory Manual,* 3rd edition (Cold Spring Harbor Laboratory Press).
[63] *Handbook of Surface and Colloidal Chemistry* (Birdi, K. S. ed., CRC Press, 1997)
[64] Ausubel et al. (eds) (2002) *Short protocols in molecular biology,* 5th edition (Current Protocols).
[65] *PCR (Introduction to Biotechniques Series),* 2nd ed. (Newton & Graham eds., 1997, Springer Verlag)
[66] *Current Protocols in Molecular Biology* (F. M. Ausubel et al., eds., 1987) Supplement 30
[67] Smith & Waterman (1981) *Adv. Appl. Math.* 2: 482-489.
[68] Brand et al. (2007) *Nature Protocols.* 2(5):1269-1275
[69] Jiao et al. (2014) *Immunopathology and Infectious Diseases.* 184(4):1085-93.
[70] Caspi (2003) *Curr Protoc Immunol.* Chapter 15:Unit 15.6.

SEQUENCE LISTING (7 sequences)

SEQ ID NO: 1 - DNA, 1372 bp, Blautia stercoris
tgcaagtcgagcgaagcgcttacgacagaaccttcgggggaagatgtaagggactgagcggcggacgggtgagtaacgcgtgggtaacctgcctcatacagggggataacagttggaaacggctgctaataccgcataagcgcacggtatcgcatgatacagtgtgaaaaactccggtggtatgagatggacccgcgtctgattagctagttggaggggtaacggcccaccaaggcgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagagcaagtctgatgtgaaaggctggggcttaaccccaggactgcattggaaactgtttttcttgagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgttggggagcaaagctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcgatctgaccggttcgtaatggaacctttccttcgggacagagaagacaggtggtgcatggttgtcgtcagctcgtgtcgtgagatgttgggttaagtcccgcaacgagcgcaacccctatcctcagtagccagcaggtgaagctgggcactctgtggagactgccagggataacctggaggaaggcggggacgacgtcaaatcatcatgccccttatgatttgggctacacacgtgctacaatggcgtaaacaaagggaagcgagcccgcgagggggagcaaatcccaaaaataacgtcccagttcggactgcagtctgcaactcgactgcacgaagctggaatcgctagtaatcgcgaatcagaatgtcgcggtgaatacgttcccgggtcttgtacacaccgcccgtcacaccatgggagtcagtaacgcccgaagtc

SEQ ID NO: 2 - DNA, 1481 bp, Blautia stercoris
tttkgtctggctcaggatgaacgctggcggcgtgcttaacacatgcaagtcgagcgaagcgcttacgacagaaccttcgggggaagatgtaagggactgagcggcggacgggtgagtaacgcgtgggtaacctgcctcatacagggggataacagttggaaacggctgctaataccgcataagcgcacagtatcgcatgatacagtgtgaaaaactccggtggtatgagatggacccgcgtctgattagctagttggaggggtaacggcccaccaaggcgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagagcaagtctgatgtgaaaggctggggcttaaccccaggactgcattggaaactgtttttcttgagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgttggggagcaaagctcttcggtgccgcagcaaacgcaataagtattccacctggggagtacgttcgcaagaatgaaactcaaaggaattgacggggacccgcacaagcggtggagcatgtggtttattcgaagcaacgcgaagaaccttaccaagtcttgacatcgatctgaccggttcgtaatggaacctttccttcgggacagagaagacaggtggtgcatggttgtcgtcagctcgtgtcgtgagatgttgggttaagtcccgcaacgagcgcaacccctatcgtcagtagccagcaggtaaagctgggcactctgaggagactgccagggataacctggaggaaggcggggacgacgtcaaatcatcatgccccttatgatttgggctacacacgtgctacaatggcgtaaacaaagggaagcgagcccgcgagggggagcaaatcccaaaaataacgtcccagttcggactgcagtctgcaactcgactgcacgaagctggaatcgctagtaatcgcgaatcagaatgtcgcggtgaatacgttcccgggtcttgtacacaccgcccgtcacaccatgggagtcagtaacgcccgaagtcagtgacccaaccttagggagggagctgccgaaggcgggattgataactggggtgaagtctagggggt

SEQ ID NO: 3 - DNA, 1438 bp, Blautia wexlerae
  modified_base (19)..(19): a, c, t, g, unknown or other
caagtcgaacgggaattantttattgaaacttcggtcgatttaatttaattctagtggcggacgggtgagtaacgcgtgggtaacctgccttatacagggggataacagtcagaaatggctgctaataccgcataagcgcacagagctgcatggctcagtgtgaaaaactccggtggtataagatggacccgcgttggattagcttgttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaataactaggtgtcgggtggcaaagccattcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccgcctgaccgatccttaaccggatctttccttcgggacaggcgagacaggtggtgcatggttgtcgtcagctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgagattgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaactgcaaagaaggagctgccgaaggcgggaccgatgactggggtgaagtcgtaacaaggt

SEQ ID NO: 4 - DNA, 1384 bp, Blautia wexlerae
  modified_base (749)..(749): a, c, t, g, unknown or other
ttcattgagacttcggtggatttagattctatttctagtggcggacgggtgagtaacgcgtgggtaacctgccttatacagggggataacagtcagaaatggctgctaataccgcataagcgcacagagctgcatggctcagtgtgaaaaactccggtggtataagatggacccgcgttggattagcttgttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcnggggagcatggctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccgcctgaccgatccttaaccggatctttccttcgggacaggcgagacaggtggtgcatggttgtcgtcagctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgagatcgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaactgcaaagaaggagctgccgaa

SEQ ID NO: 5 - DNA, 3415035 bp, Blautia stercoris (residues 1-1,707,518 of 3,415,035)
  strain 830 chromosome
aactgtggattttttacgagtccagtgtaattcatcttcaaaagttgatactgcactttctgttaatgcaatggaacttgtgattgccgcaaacaatactaacaggaaaaataaaattccaaccgcagttccgaatcccatatttgcaaatacttttggaatggtaataaacatcagtgccggaccagcatttaaggtatctgcatttccaccggagaaagcaaatactgccggaataatcataagacctgccatgattgcaattgcagtatcaaaaatttctacattttgggttgattcctcaattgaagtatctttcttcatataagaaccaaacgttactaaaatacccatcgcaattgacaaagaataaaacatctgtcccattgcagacactactgtcatccaggaaaagttcttaaaattcggtactaagaaatattttacaccttcaattgctcctggtcttgtcacagaataaactgcaataataactgataatacaaccagaatcggcatcataaatttagatacccgctcaattccgttacgcacacctgcataaataattccaagtgtggcaagggtaaagattaagaaacagatttctgttgataatccatttgaaataaagctggaaaaataatcatcggaagccagattcttggactgtcctcctatatatcccaccagatatttaataacccatcctccgataacggaataatacggtacaatcagaatcggaataattgcattaatccatcctccaactgcaaatccctttgactttccaaagtgctcaaatgcaccaacgggactctttctggtcatacgtcctaaagaactctctgccataatcatggtatagccaaatgtcagtgccagtatgatgtagaccagtaaaaagattcctccgccatatttcgctgccagatatggaaatcgccaaatatttccaaggcctacagaagcaccggctgctgacaatacaaaaccgagttttccagagaaggtacttcttttcttgtttttgtccataaaaatattctccttcttttttgaatatacctcttagtgtaacataggcatggcaaaaaagcaatcataaggactggaggttttttgtcaatcaagtggatattcgcaatccgctttgctacttgctcataaccaaatagctgctacgcagcttatcagaagggacttgccccctcctgatacaagcaagtccccacccctgcttattgcttttcgcaattgaagcaggggacttacttgatttggttaaattaaaaacagagagaacctttcaaccggaactctctgtttttggctctctcatcatttaataaataaattcaggaaaccggtagactgtaagaacaaaatggtcataatcaccggcatgatgtaacaaatcataatgttatataatttttttcggccaaatttgccaccatttaattccatctcttccgcaatccacttcggtttcataatccatccgattaaaatagaagaaagcaacgaaataaacggcatcaggaaactgttactgatatagtccataatatctaataactgtccgatacttccattcggaagtttgacttccacataaaagatactgtatcccagagcaatgactgctgttgcaattaagtaaataacagataacacttttgttgtaatttttctttttgcatgaaataattccatacagttcgcagtaatagattccaatacagaaatacaggaagttaatgctgcaaatccggcaagcacgaaaaatacaattccaattaacctgccggcaaatcccatactgaagaatacttttggcagagaaacaaacatcagcccaggaccggcggacattccgtctaatccagagaatacatagacagccgggataatcataacacctgctaaaaatgcaacaccggtatccataatttcaatctgggatacggccttatttaaatcaacgtctttttttacataagaaccataagtaatcatgatacccatagatacacttaaagaaaagaataactgactcatggcatccagtgtaatctgtaagaaacgactcactgtaagcccggagaaatcaggagtcaaataaacttttaaaccatcaataccggttcttactgttccatcatccagtgtattcttcagagttaatgaaaagatggcaattccaattaccatgactaaaagaatcggcatgataaacttagaaactcgttcaattcctttttcgactccattataaacaataagagccgttaacagcataaagataacaccaaaccacacagaggatggcgaagaaataaaggaagtaaaacaattatcatctactgcctgttttcctgaactaaacaaataaatagtaatatattttaaaatccatccaccaataactgcataataagtcataatcaataccggaacaaggaaagtcaagattcctaaaaatttccattttttacgcattgactcataagcgtaaatcgcactttttccggtttttcgtccgattgcaatatctgtagtcagtaaagtaaaaccaaaagtcaaaaccaatacaagatagataatcagaaaaagtccccctccatctttcgcagccaggtaaggaaacctccataaattgccgactcccacggcacttccagcggcagcaaatacgaatcctatctgaccgctgaatccacttttttgtttcattctctttcacctcatcttttttatttaacatttagatatcatgccattaaaacaatccagacctcatcagtcagtgtgttgatttgctacgccaaacagcgtctgctactccttcaccggaattttcattggtacattttatcattaaacactctttattgtcaatttctttatttcaaaaaatcctgtacattatctttcgtcactttttcataaggcaaatagatatatctttgattttcaaattccacttttttcattttttctccggtaacaagctgacgtgcaagctgtgccattgcatttgcctgtgcctctttatcattatataccgtagcggccatcttttcttctaaaacagcttctaaaccttcatctgtgccatcaattcccaaaaaggccggaatatcagtctctgtatagccgagcttttcataggcatcaatcgctccaagtgccatatcgtcattatttgccagcacaagttcaatctgattgttatattgattgatcatctgtgtcattcgattttgagcctgtgcccgattccagtttgcgatttcataacttagtttttctaattcaactcctttttctttcaaactgtcaactgcgctctctgttcttacgattgcgtcctgatgtcccatttccccttccaatacaacatactgaatttttccgtctttatttcgatcaaccgtttttcgttcccaaatcaaatctgctgccagctctccctgcatgactccggactgctttgcttttgctccgacataatacagtttctcccactggttcaaatcctctgccacaggctcccggttaaagaaaatgatcggaatatcactttcctttgccgcctcgataatttcagacggattggttcgatctgccagattcacacaaagcacgttacatccctctttgattaaacgcttcacctgatcattctgtattttttgtgaaccggctgcatcctgaaccgttacagatattttatgttgatttgtttccagcctgttgcactcttctttaaaacaggacaccagttcattgatatacgtatcactttgattgtacgaagcaagcccaatatttattttttcggtttctgttttttccggcattccacaggcacttaagccacataagcataccaaaaacacgaacgccagttttttttgtttcattttttcttcagcctctctttgttttcttactgactcatcttaaataacaattcctgatttttttctgaaaataaattttcttttcgaagcacagtataagataatactttgccatgcacacaatacgtcattttttttaaagcgtgtgagagttctaccagactttcatatcccacattaaattcatccggtacaagcaaacactctgcttctccggtatccagataatatgctgcctctgtcgagcagccaattccataaatcatagaaccataaatttcattttcttttaccgcttttcctgcctctaccagacttcgatcatctaacgcaaacagataatctaccttttcctgctgttttaatagctttgcatcttctcccgcttctgtcacccaacagattttggcatctgtttctgacaaagcatcctgtactcctttttctcgctttttaattgcttcagaacgattattacttaaaaaaattccgactttcttctgctttaattttccatcgttatcctttaacaactcttctaccagacgttttcccatttcataatggtccggctctgctacaggaattttggaagtgttttcaggcgctgccgaaagttcagaaagcaataacaccggtacctttattttttttaactgttctgcaagcgtttcgtctgctaccggctcgataatcagtgcatctgctcctttatcaatttcatgttgaatagcagacatttcctcttttgcagtctgaaactgtgtcggatttataataaatacatccacattttcatcctgtgctgccatctttaatccatacttaaaagccgaccattgcgtttcatctgaattttgaatgattacggaaattctttttaaatcctgcccttgcctcttttgaactgtaaaaataatcattccgatcagcaaacatcctaaaatgcattccactaaaataaacatttttttgctacttttcataaatttattccctgtcttttttctgtatttgatccttgctgaataaataacctttttcaagaatccgacgattttcttctgtatatacgattgcaggaatacgaatcaaaactgttgttccttcatcaagttcactttcgatttttaagccatactcttttccaaataagatttgaattctgttatttacattcgtaagccctactcccgaacctttcttgtgaactcgattcgtatccatcaaaagaaattcaatttcttcttccggaatcccaattccattatcaatcacggataaaatcaacgttccctcttcttttgttacctgaaccttaatttctccgtcctcatcttcttccaacaagctcattccatagttaattgcattttcaagaattggctgcagcgttaatttcaccgcacaatattgttccaattcttcatctacttcaaaagcaacctgaaatttatttttataacgcactttctggatattcatataactttttgcatgctgcaattcatcttttaagctgataatcgtatgcccttttgaaagactgatgcggaatagttttgcaagctgtgagatcataaacgtcgcttcatcgtttcgctctccctcaatcatccaggtaatcgaatccaacgtattatataaaaaatgaggattaatctgactttgtaaggcatccagctcactttttcgcctttcattttgctcccatacaatttcattcatcaacatttcattgcgtttataagaattttggattgacttacctaaatgccggatttccagagaaccaccaatataaatatccggttcttttccggcctcatgctctgataccgaatgattcaattttaaaatcggacttgaaattcgaagtgaaacaattcgattgacaagcactaacatcattgccattaacagcatcaacatcacaataaaacattgcaaattcgtcaactgatctgtgaaaatcgaatacggtatcacaccaactaatttccagccggtataactgattggacttacgattacctttctatgttttccctcgaagtattcatcataaatcatcttttgtgattttgcggccgcttcgctgctttcactgagctttccgtcactaatctgcatctgtctcggatgataaatgattttgccattactatcacataaataaaaatactgcccattttctaaggtgttaatctgatccatcatacgtgagatttcagaataatccatatctaccaacaagacacctttttgtgaatttacaccatttgtcaactccacaacacgacttgaagaaataacccaataatagcgaaacgttccatcatcaaataaattctggatatgtggaatcgaaaaatgtatattttccatttcatccatcgcatggataaaccaatcctgctttgtcacatttggatcctctttttgagatacgaccggctctgctgcaatcagacttccaaaattattataaattgcgatacttcttaatctacttttatttgcttcatataataactgcattcctttttgaatttcttctgactccgtagaaaaatcgctttcttttatcacactataataagctgcatcggaaatttgtctcatattcatcagataatcttccatgctttctttgctttgttccatcagtttttgtgtgcttttaatcatttcctgcctggataagttagagaaacgcatatacattacaattcccgtaagcagcatgattgaaacagaaataatagaaaacgcaaccataatcgtcgactggattccgcctggttttaatctctctaaatagtttgcgattttatttctcaccttttgcatactccgttctatatttcgatggagaaactccatattgtcttttaaatacataactaaaataatttgcgtcggtatatcctacactttttgcaatcatgtaacttttttcgtttgtttctattaaacgtttacatgctttttccatacgatactctgtcagataacccacaaaagaatttccggtctcttttttaaacatgctcgaaaaatacgaatttgacactcctaattcttcacaaatatcatccaaagaaagcccttcttctctataatgactttctacataggtttttgcttttgtgatcaacgactttgtagaagacgaacgggcatctgtaatctgctcccgaaaagagaggctcacttttaacaaccatttttttagtccttccggttctaaattgattaaaatctgataaatctctcccatttctccggaaaactctttactgctaatttcattattttcagaaaaacgatacaaggtactgattagttccattaatgcaacatgatgtttttgtagtgtctcagatggcacaaacaaatgttttaaataattttccacgctttcttctatttgtgcttcggagccaaggcgaatcattttaaatagttctaaaagttctccctcgcttgacacttcctggtcgacctgttttttcgggacaatttccttaatattaattgctctggaacttccatataatactctgtaggaaaccgcctcttttgccccttgataagattttgataattccagcagttcgttacaaactgccccaactccgatggtggtaacggcgccaagaattctatgcacatatttacaaaagcggtcacattcgtctgtcaattccgaaatctcactttcctgtctaagctgtacaattaaaacagtatttcctaaataagcaaagcatttcgctttccattttggtgctaattgctcttttgcctgcctttcaactgaaattgctaacaattgcggattcattccttccggcacccgattggtcgatgtatgaatcacgatgcagccaaacacaggcgcttcaaattgaatttgataatcttttaaatattgttctaactgttcttcataaatgcgtccttcaattaaagtcgaataaaagtttgcctgaagcagcggtaaggaatccatataatacttttgcagcgtttctacatttcgtttttcgtcgatttcctgatccaatttctgttttaattttgcaaatacttctgttagttcaatcgcatttaacggttttaagatatattcttcgatctccaagtgaacggcttcttttgcatattcaaattcatcaaagccggtaaataacaaaatttttgttgtcggatatcggcttttgatttcgccacaaagctgcatcccgtccatataaggcattcgaatatctgtcattactacatccggttggaattcctctatcatctcaagcgcctttaaaccattattcgcatgaccaattacgcaaaatccaagcttgtcccaatctatttttctttcaatcacttgtgttacttcttcttcatcatccaccaaaagcaagctatatgtattcatccgcttttctccatttttttaattttctttttattatacatgattttatgcaaaaaaagaatcctgcatttttttgcaggactcttccttttgtcttgattttttattattttttctgtacgtattttaagcagtccagtgttaccgctacaagaataatgatacctgagaatacgaactgaaggtttgtatcaataccaagaatagtaagagaataggtcagtgctgtaaagataaatacaccggttacaacgcctgaaattttaccaataccaccggtaaaggatacaccacctacaacacaggctgcgatggcatccatttcccatccctgtccatatgctgcggaaccggaaccaaccattcttgcacattccagccaggcaccaaatccataaagaatacctgccatgatgaatgcaccaagcataactccaaatactgagataccagaaactgctgcggcttccggatttccacctactgcgaaaagattttttccaaatgtggttttattccagataaaccatacaattgcaactgctgcaacagcccaaagaataatagttgggaaaccatttacttttggaatgatcattcccggaatagatgcctcaatcgcaccaaaggatacaccttttgttgaataagtaactaaaccaaagattacaagcatatttgccatcgttgagatgaacggatgcatttgaaatttcgctgtaaaaaagcctgcaattgtagtaaacaaagtacataagaatacacacacaactaatgcaaggaatactctgcctccaacagacattccggtaaagtcaaacacatgtccaaatactgtaccggtatttataccctgatgcatgataatggttgctgcagtcatacccataccaaccatacgtccgattgacaagtctgtaccggtaagcaagatcaaacctgcaacaccaagtgctaagaacattctaggagatgcctgctgtaaaatgtttaacacattgttataagttaacagtggagtaccttttttaatcggagtaataatacacagtgcaacgaatactaagataattgcaatatacaatccattctgtaagaagaaagaacgggtattaaatttgtatttgtagttttcccatttctgctctctggtctctaagaaagtaaattttgacaaacgaagcatatcaattaaatgatatttataactaaatgcttcatgtttttcgtctttaattgcctgatactctttctgcaactctaattttgcattggataaacggttcttataaacgtaattttcatctttaatttctttttgctcttttaatccggaaagaatttctttatgctgtctctctaactctgcaactctttctttatagtgttcctgagcctgtactttttccgctgcacaactttcttttaccggtgtgtaatactctttatcaaaatgagcttttaaataattttctgcatctgcaattaattttgaaatttcatctttatttttattttcaactgcttttgctttttcaagttcaacctgatactgtgaaattcggttttcacgttctccttttgtaagagtacgatcccttttgattccatcaataacattttggtactctaatacctttgcagtaccatcttttctaagtacatcaatttgtttttgaattttaccaacatattcgtcaattggctgacgaagtttcatcttatcttctgatgtaagaattttactatttgccatatctatcaatctccctttattttacagatacttcgcactcagtctcaaaagttcttcctgattcgtctcttttgtatttacaattccagaaagacgtccatttgacattacgccgattctgtttgtaattccaagaatctcaggcatttctgaagaaactacaataactgtttttccttgttttgccatgttaataatcagctcataaatctcatattttgcaccaacatcaattcctcgtgtcggctcatccatcataaatacttttggatctctctccaaccattttccgaagatgactttctgctggtttccaccggaaagacttgaaatcatatcatccggtcccatacacttggtatgcatagtcttgatttcttttgatgttgctctgaccatttttggatcagaaagtgcaactccgtttttatatgcatttaagttggcaatggttgtattaaatgtaaggtctccttttaaaaacagaccatttgctttacgttcctctgtaatcatagcgaaaccatgctccattgcttcttttgcactattgaaattcatcaactgatggtttaaatagacacgccctgctgctcttgtccttacaccaaaaattgtttctaatagttccgtacgtcctgcccccacaagtccgtacaacccaaagatttctccttctcttacatcaaatgtaatatcatcaagatgtggctcaaacttcgttgacaaatgctgaatcgataacacaacatcttttggaacattgtctaccggtgggaaacgattttccagtacacgtcctaccattgaagcaatcaactcattcatgtttgtctcttttgaactctttgtcataaccagatttccatctcgaagtactgagatctcatcacagatttcaaaaatctcatccatcttatgcgaaatgtaaatcaaagaaatcccctgtgattttaacattcgcatcatttcaaataatttattaacttcttgtaccatcaaggatgaagttggttcatccagtacgattactttcgcattataagaaattgcttttgcaatttcacacatctgtcgctcagataccgacatatttttcattggctgatctaagttaacagtcattccaagctttctgaaaagttcagatgcttctcttttcattcggctttcatcgatcattcccattgaattgaccggatagcggccaaggaataaattatctaccacatttctttccaaacactggttcaattcctgatgaaccatcgcaattccattttcaagagcatctttcggtccggaaaagcttacttcttttccatcgagaaaaatacttccctcgtctttctgatatgtaccaaaaagacatttcatcattgttgacttaccggcaccattttctcccataagacccattacggttcctcgtttcacatcaagattgatgtgatccagcactcgatttcggccaaaggatttactcattccacgaatcgataagacattttcttctctcttatctgtcatattctcactcctgtaaacattcgttagcgaaattttagggggaagtactcccccctaaaacttacttgttttcattccttttttttacatttaaattactgatttaaaattgcagtataggaagctgcgttatctgttttaaccatgttgattgcaaatgcatcatactggcttggatttcctaaacggtttgtgatattagattctgtctgtccatcacctgcaatatattcgatatccagatttaagagatcatcatatttctgaagcagtggctgataagtagaacctaagaagttatcaccagagttatagatgtttaaccatacttttttagatggatgtgcagattcatctaactgtttagatactggttcccaaacaactgtagaatctgtaaagtctgtgtagttgtctgctgtaaccgctacgtttaatgcatagtaagaacgttcgtcttctttgtatgtatatacatcatcacttaatacgtttcctgcatcatctgcggttccgatacctgtatcaatatcaacaccgtctaatgagttacgcagtacacgaagtgttaaataagcctgtacgtctgcatgctggctgattgttccgccgtatccttctccgattgcagcaactgcatcgctgtttgcatcatatccgaatgtaggaactttgttatcttttgaccatgcattgaacatagacattcccataccatcgttgtttgaaacaacaacatcgatgtctttaccaaaagaagaagaccatgtaccgattgcattacctgctgttgcagcatcccaggttgcacctgcggagtttttcatttcctgagaagctaactcacgtacaacatattcttttccgtttacttcaatttttccatcctgtactgctgttgcggtaccatcggtatttgttccaaccggagcactatctacttcaccatctttttcaactgcggttccaagagctttacgcacacctcttgtacgtgcgattgagtcattatgtccgatatctccgactgccaaaacataaccgattactccatctccgttacggtcgattttgtcaatatttttctcaatatattcttttaccattgttccctgaagttctgcaccctgatttgcatcaaaacctacataataagtatctttgttgaagtttaatgcagttgtatcaagttcacccgttgaactgttagatggctgacggttgaaccatactaaaggtttatctttgtttgctacatctgagcttgcctcagcgccggattctgtttttgcatcatctttctttgcactgtcaccagagtctcctgaaccacatgctacagttgaaagcgcaagtacgcttgccattgccattaacgctaattttctcttcataattttttctccttttcatttttgctcaagtgttttgtttatgttgacagtatatcgtttttaccataaataaactatagaatatttttgggtcttcattaaaatttttaggataatcttcgttattttgaccatttttcatcttatgctgacgcagtttcttacaaaaaaatatcgccagccacaattatgactgacgatatataaattcatttttatttttttgttataatcttgctacccctgtttttctggctgcttctgctactgcttttgctactgccggaccaactcgtttatcaaatgcttttggaataatataatccggatttaattcgtcatcggtaattaaaccagctaatgcatttgcggcagcaattttcatttcatcattaatgtctttcgctcttacatcaaatgctcctctaaagattcccggaaatgcaagtacattattaatctggttcgggaagtcacttcgtccagttgcaacaacctttgcaccgccttctttggcttcatccggatagatttccggtaccggatttgcacaagcaaaaatgactgcatctttagccatgctctctaccatttcttttgtcaccatcttcggcgctgatactccgataaatacatccgcaccctctaaagtttccgcaagagaacccgcttttttctccagatttgtaattttgctcatttcatttttgactggattcatgccatctgctctaccttcatagattgcaccatggcggtcgcataaagtaatatttttatatcccgcttttaataataattttgcaatcgaaattgctgctgcgcctgcaccattcattacaatttttacctgtgatttttcttttttcacaagcttcattgcattatttaaaccagccagtgtaatcactgctgttccgtgctgatcatcatggaagatcgggatatcacatttttcttttaattttctttcgatttcaaaacatcttggagccgagatatcttccaggttgactccgccaaatgaaccggaaatcatatagatggtattaacaatttcatccacgtcttttgatttaatgcaaagaggaaatgcatcgacatcaccaaacgctttgaataatacgcattttccctccataaccggcattccggcttccggtccaatatctcctaaacctaatacagccgaaccatctgtaacaactagacacatattccatcttcttgtcagttcataagatttttcaatatctttttgaatttccagacatggctgagcaactcccggtgtgtaagctaatgacaaatcatcttttgtttcaaccggaacatttgctacaacctgaatttttcctttccactctttgtgtaatcttaatgattcttttgcataatccattttcgtttttctctctttctctaattatttttaataatttccttcaaagaatctactgtctttttgtaactgataacccttaaaataactattaaaatccaattttaagtattcacagagatttgcaagttctgccattgtattatcgttgacctgaattccattttccagacggtctttttttgccagcacttctttttctccgtgtgtataaattcgttctgctccatctgcttttggactttctcttaatgcttctaggtattcagaaaaatgtttcttaatctcctccggatttccaaaaattgccgggttcactgcaataaatccatggcagatacctgttttatctttaaaagtgcaacatttatcagaagtgacaccctgtgataaaatagaactaaataattcacataacattccgtatccgtatcctttgtggcttccatttacttctttatttccaccaagcggcatgattcctccgcctcgttttgctacaatatttgagagtacatccggtgcatctgtgctttcttttccgtctttatcaagtgcccagccttccggaagtggtttttccattttattatacatttccagttttccacgggtcacaaccgttgtagaacaatcaaataaaaacggatacggttctgccggcattgccactgcaatcggattggaaccaagcattgctttcttaccaaatgtcggaaccataattgcctctgaattcgtgcatgccataccaagaagtccttcatcactcgccatctttgcataataaccggcaattccaaaatgattggaatttcttacactaaccattccgattccggatgtttttgctttttcaattgcttttttcattgcataaatggaaatcagctgccccattccattatgcccgtcaatcacagctgaaaccggtgtctcaaatacaacttccggtttcgcaagaggatgaatggttcctttttcgattcctttatgataacgtaccatcctctgcataccgtgactctcgattccaaataaatcagcggtcaaaagcacatcctctatctctttgctctgtgtttcatcaaatccaaatgcacgaaacacatcatggcaaaaatgttccagtactgaataactccattttacatatcccattgttgctcctcctttggtattccgtattatatattggtattgccaatttttaaatgaagtataccaccattcttttcttttttcaaccttttttccataaaaaaagaagaaaacttttttaaaagctttccccttttttctttcgatattctcattgattctcctgcatcatttctgcacgttcttcaatatatttttctatatttatcatatgttcctgcatataacgcactgctgattcttcatcatgtgcaataattgcgtctaccagtctcttatgctgttcatcaatttctgtaaccgacatttgtttctgcataatataagcacgaattcctgtaataatattttctgtcagctgggaagctgcactcattacattaaataacattggattatttgccatttttccgatctttatatgtaaatctctgtccaaatctcctcttatctgttcatcttgttctacctcaagttttgctaaaatcaattttaattccgccgcatcaatcggagaacaatttctggcagccaattttgcacattggatttcaagtgcggaacgaagctgctgattttgctgaacactgctgttatttaactgtaataaaatcgaaagcggaccaatcatacaattttccaaatcttctgaaatataattcgcccctccatgaaccgtttttataattccaagaagacttaaagaccgaagcacttctcttataaccggtcttgaaacccccattgcttctgccattgcacgttctgccgggagcgcatctcctttttttaatctgcctgctctgatattttcgataatctgatttaaaatttcatcaaacgcattttctttactaatctgcctgaacatatttctttccttcctaaaaaataatgcttttctttttcatcctttttttattatacgtcttttcattttaagtaacaagctgaattttatagcaaaaagaaaagcctacgaagaaaatttctcccctacttttgtttgattcaaaggtaggggactcctcctgatacaagcaaatccccacccactgcttattgcttttcgcaattgaagcaggggacttacttgattcggttaaataattgctttatgttttcttctgattacttcaagaatcacaagtgtaacaatgacaccaaatgccagtgatatccatgcattttgtgtgaatcctgctaccacataggttacacagctgattgccgcaacggtaagagcatatggcagctgagtagaaacatgattcacatggtcacactgtgccccggcagatgccataattgttgtatctgaaatcggagagcaatggtctccacaaactgctcctgccatacatgctgaaatggaaataatcataagctgtggatttgaattctcaaatacatgtacaacaatcggaatcagaattccaaaagtaccccaggatgttcctgtcgcaaaggcaagtcctgctcctactaaaaagatgattgccggtaaaaatttcataaaacttccggcacagccctgcatcacagtatccacaaactccgctgcaccaagactgtctgtcattgcttttaaagtccaggcaaatgataaaatcataattgccggtaccatcgctttaaatccttccggaatacatcccatacattcacggaatggaagaattcgacgtgccacataaaagataatagtaattaaaataccaaacatacttccgattaccagcccgacagaagcatcactctgtgaaaaggcagttacaaaatccacgccggagaaaaatccgcctgtataaatcatacccaatacacagcagacaacaagacttaagattggaaataccaaatctattacttttcctctctgtgttacggtctcattttccgctgttgcataaggacgagctgatgtagtataaatatcaccattgattgcattgtgctcatgtgttctcattgaaccaaattcagcttttaataaaaccattccaaccatcataaccagcgttaacaatgcataaaaattatacggaatcgcttttacaaaaatcgtaagtccatcttcgccctcaacaaacccactgactgccgctgcccaggatgaaatcggagcaataatgcagaccggagctgcagttgcatcaatcaaatatgctaattttgcacgtgaaatattttgtttatctgttaccggacgcataacacttcctacagtaagacagttaaaataatcatcgataaaaataagaacaccaagtaaaatggttacaagctgtgttccgatacgactcttgatttttctgccggcccatctgccaaaagcagcagaacctcctgctttattcatcagacatacaaccgcacctaaaataacaagaaagattaagattcccacattataagaatccgatataacagaaataaatccttcctgaatcatatggacaacggttccttcaaaactaaagttcgaataaaacaatgctcccactaaaattccaataaataaggaactgtacacttcttttgtaatcaatgctaacacaatcgctacaatcggaggcaccagtgcccaaaaagtagcatacattttcggcacgtattctgctgcctctccatctgcggcaaaaactgtcaccgcacagaaaaaggtcagcatgagaactgccatccctcctgtaagcagtttttttcttacgcttttcataaattttcctctctttcttttggaatgtactccataagagtacatttgatttctttatttaccggactttgtaacatccaagtcgaagattaaaacaaaagaaaaaccatgaacggtttttcttcgcaaagaacccattcatggtttttattcaaaataaccctgagatagctctccacattcgtgacagtataatgcatcttatccattatcccagagattgtatttttgagtgcaaatccatcccttcggcagtctcccctttcttgtttacctgtcactcaccatctggtaaaaaatactcttgaagcccgcacctctatcttttcctctttttatctttttatccggcttatgccagaaatctttttctttaacaattatactataccatcttacaaagcaaaatccaatacttttcgacaaaaacttttcgatatgcgttttacacaaattatattgtataaattccaaaattatgttaaaatagtataaacaaaattcggattcattctatattttttatgtattctgaaaaatttttgagatattgtatatgcatttaaggaggggtttttatgtcaaaacaggtaattacaattaaccgtacttatggcagtaatggacgtctgattggaaaagcactttcagaacgtctaaacattcctttttatgacaaagaattaatcgaactggtcagtcaggaatgtaatattccggcaaaagaattagaaaaagtagatgaaaaacgcgcaaatcaatggcatcttcctctaaaagaagcaatgcagatggaaccacagtatcattttcgtcctatgaacgacgtattgtttgatgcacaatcgactgttatccgtgaccttgctgaaaaggaagactgtatcattgttggacgctgtgcagattacgtgcttcaggaaaagaaaaactgccaccgggtctttatctatgctccatttgactaccgagttcaaactgtaatccatcggctcgaccgcaacgaaaccagcgccaaacgacttgtcaaaaaaatggataaagaacgccgttattactatgaatattttacagaccgcaagtggatggatatgaaccattatgatttatgcatcgacagcagtaaattttcagaaacagccatcttagatatcttagagactttgtatctaaaataattaatctccgtgagctaataaccgaacttcttaacttaaaagggagtgtcagactggcactccctaaaagcatcatcattatttatttttaattttagttattttatttttgtaaagcatccttaaatttttaccactctaagagcactgctccccaggtaagccctgcaccaaatccggaaagcaccagtttatctcctcgatttagcatcccatttcggttcatttcatcaagcagaatcggaatacttgctgcagatgtatttccatacaaggataaattcattggaaacttctcttccggctcttttaaacgttttgcaacagactgaataattctgctgtttgcctgatgcagaatataataacggatttcttctttttttacttctgcttttttcagaacttcttccacacactccggcaccgtctttactgcaaatttaaaaaccggttgcccttccatatacaggtactcttttgtttctgattcatgattcagcaaatttctggtttctcttgccttacagcttaaaactccttttcctgccccatttgatttctgaaccagttctaacacccctgtctcttcagcactgacaaccgctgctcctgctccatccccaaataacacacaggtacttctatcactccagtctatcatttttgacatcgtttctgctccgacaatcaacgctttttgatagattccaccttttatatacgcctgcgcagtacttaaagcaaataaaaaccctgagcaggctgcacttaaatcaaatgccacagcatgctttgcaccgattgcctcctgtacctgacacgctgtattcgggaaaaaataatccggtgtacacgttgccacaataataacttcaatttcttccgcagtgacacctgcattttctaatgctctttttcctgctaaaattgcaagactcgttgtgttttcttcttttgcaacccttctctctttgattcctgaacgactgctaatccattcgtcactggtttctactatcttagataaatcttcatttgttacaatctgctctggaactgcacttcctgttcctataattctggctgtcattttatttacctctattttcaaatattttgataatcaaacaatatatagcaagtatacaaagaaagagattatttgtcaacacaaacaacctcttctcttacgcagtcttattcactttttttatttcttctctcttggttcataaattttcctgatttcctgtgagagttcacgatttaaatcatctaaatctacaactgagtgaggctcataattggaataactgtttttctgttcctgctcttttggctcgtcctctctctgattccggattcttctataagaagaatcctcttccttggaaattcctttccggtttggatttccttttttcttattcgtagtcttattatcctgctttgttactactttattgttagtctgataaaccgtttttttcttttttttctttcttgatggcagggatggaagtgtcggaagtgaaaaacttcttgggcttctttttcttctatctgaaaatctgtctgacgaaaaacctctttctcgactttgtttgcgcagataaggtcctgcctgtattacaataccaaatattccaagaatcagtcctaaaagccagaccgctgcattttcctgcattttagaaagttcaaacaggcattttactgctccaattccgccacacagaccagtaattacaatcactacatgtctctcatatcctaatgccatcgtcgctactacaattccgactgccagacagataatccggcttgtcacatcttctcctgaaataaaggaagaagccaaccagtaaatcaatccggtacaaagaataaaaatacctgctttataaaagcaccaggctatcatcccaagaaacagcgcaaccaatgctccggcaattaaaatataactctgttttcctccaagataataccatgctgccgcacctccggctactgctccgattgccagtcctaaaagagttccccatacttttctaagccgatatcccataaaacagtttagcagtgcaaatatcattcctgccagtaaaatccccgtcatatatttctgtgttatattcccatattctgaaactaccatgtttaatatctgtgttatattcatctctttctaccacctctcgcacctacctaccttaacacacatattttaacttcttaagttcattaatgtgaattttttatttcttttcctttaagatatgaattacgaatgtaacataatgtttctttttcacctttttctgccaacattcgtaataaaaattccaaatcacggtttgtatcctcatgcacaaaccacaatttacccttgcttttcaaaaaatattctaaaggcgcacggttcgtataagattccggatgatacacttttgaagcacaaatcctgtccatcaccatctccgctatataattcctcggcatcggcactccttttataatggtatcacaatcaatcccataatctacccaatgttcaaaatgatgtttatttcttccatagtgatgaatccacgctgttgaaagccctgttgcttctctctccgcattgtttggactgcggtttccctgataatatttacatcctgctgaaaattctgtccatgaatactttgacaaatcatggagcattccctgccgatatagtcctattttaaagcaatatttcataaccatcagtttatgttttgtaattgttttaaaatgtccccagatatgcattaattctcatcctgctttccttttaaaattactacggttcttggtccaacctttattgttactttcttcttttgaatttcttttttctttttatttttttctgtcttttcttcttttaaaatttccgtttcaatctctgcgtcttcaccacttgtcagaatctgttcccatgacattttttctgaaagacttggcagtccaaattcatgttcattccagtgaaaattataggctgcaaagagcagctctttttcacatccggcataatcttcacagtatagaattcctatgtgacggtactgcggacttccggaataataccacggctgattactatgataagaaatatccggatatcccacagctttataatctgccccttttaattcgctttccagatgcaaaatcgaatgcatttttcgaatggaaaccgcttcttttacaaattcaaacagttctttattctgacgcagttttttccagttcacccatcctgtttcattatcctgacaccatgcattattgtttccgccctgtgagtttccaaactcatcaccctgaaaaataagcggtgttccctgacttaacaacaacataagaaaagcgtttttcaactgtcccatgcgaagccggcgaatacttttttttctgctgtacccttctgccccacagttccaactgcagttatactcaattccatccctgccattttctccatttgcctcattatgacgttcatcataagagaccatatccatcattgtaagaccgtcctggtctgccatataattaatcacaccactgtttttgtaatttcttttatttcgataaagaaattcttctatcattccctcatcactttttaaaagatgacgcatacaatataaaaatccatcattgtactctgcaatatgccgaaaagacggaatctgtttttgataaatctgctctgcattaatatcagaaaaaaataatttactctgtgaaagccatttatcttttaccaaaacttccggcaatacgccctttcccatcagatgaaatccatcaatatgatacgttttcatccaataatgcagaatatcaagtatctgtgaagaaccgacacttccatcaaaataaaactccatcaggcactcaattcctgcaccatgaagcgaatccaccatcttacaaaattcctgatatggataatcggtactgcaaaaagaggcctttggtgcaaaataatttgcttctccggtatagccccagcaatttacccgtacctgtttttttctttctccaaagcgttctggttcttttacttcttttgaacattcccgatactcgtaagccggcatgaaaagcacacctgtaattcccagcttttttaaataagcgattttctgctctactccacgaaatgttcctttctcccttactccggaatccttatcttttgtaaaaaaacgaacctgtaatttatataaaatactgtctgagagtaaaatcggagaaaatttttcttttttccagtgataattttctttttgataccgacatcttactgcatgttcttcttttggatattcttttccaaattcactcactccgctcaaagaatgtgcataaaaatcctgctgcacttccccatccacacagtagttatactcatactcatccatcgaaattccggatatcataactgcccgatagtcgccaaaacttttttcttttgaaagtggaaccgctatctctggtctgctttccccttttttataaaaaagcagacttacttctttctctgcttctatacatgctgtaaacacatatccttttcttgtttttacgacacccggactttccggataaacaactctccactgcagtttattttccgtctcactcacacattctctggacaagcttttcacctcatttcaatttttcctgttccttacacagcacttccattctgtcatgtacactcgaagcatcagactcatcagtcattgtgacaatcgtatccccattcataagaatcgtatgtccctttggaatgagttcacttccacttcttttaattgctactaacagacagttttttggccattctacctgctgtatcattttattttgaatttcacatccataacttacaatatattcctgtaaaaccttttctccggtctttttcgaaactttgattcctcgtttctttaacaaattggtaagcagactttcataaatcggttcggatttaaatgccgtagccaccagataagcgacaattgaaaccaaggataacgacagcatctggctgaaacttcctgtcatttcaaaaatcagaatgattccggtaatcggtgctcgtacaattgctgtaaaataaccagccattgccagtacaataaaattgctgatatactgtgaatccatcccaagatatgtgactgcaaaagaggcataagcgcctccaattaaagaacctaatactaaaagcggaaagaaaattccgccaggtgctcccgaaccaaaagaaacgcatgagaaaaataacttcatcacaaacagaaacaggattccctttaacatcatattgccttcggcgaccatatcaaccagattatgtccgcttccaagaatttccggcattgtaaatccaaaaaatcctgccatcaaaaacggaattaacagtcttatcgtctctgatcgttttccttttatttttccaaacaattcctgactctttaacgttactttattataaaaagcacccataatacctaaaataattcccagtgctatgatatgtccataatatgaatcaggaattgctcctgtcacctcaaactgaaaaaccggacgaaatcccataaattccgccgaaatataatctgcggtaatcgacgctgtcataacggaaatcaagaccgacaccgaaaagtttttatgtatctcttctaatgaaaacatcacacctgcaagcggtgcatgaaatgctgcggcaagtccggcacttgctccacaggtaatcaaatatttttcttctgtttttcctcttccaagcaggctcgaaaccgcttttcctgacattgctccaatctgaatcgacgggccctctcttcccaaagaaagacctgcaaacaaagataaaaaacctccaagaaattttgctggcagaaccctccaccagacctgatttaattttcctgccatttcaccttctacctgtgggattccacttcccgaaataaaaggttccttttttaccagccatccaacaatacatgccagcgtaaataagataaaaaaccagactcctgctgcaaatggatactctcttcctaacgcaagcacaaaattcatgacttttcccgcatattccaaaaggacacgatacgcaagtacaatcaatcctgctacaactccaactaaaaagccttctactgtcaagattgatttaaaatgtgcagccctttttatcaaatgagacgtatcttctttcactttctcttctcctctctcatccgtaaatgtgctcttaaaatctttccagaaacattaagagtacatttagagtaatacttttattatacgtgcccatagtaaaaattgcaattgccaattgtcaatgcttgaaatctttcaagtcatctggtactattaatataacactataagtattaagaaagaggtaattaccaatgagtgaagaaacttttacaaccaatatcggaggatgtgacccaagtgactgtgcgtcctgtacttcagactgtgccggagccggacaggcaattccacgcgttccaaatcctaccattaagctgaccttagaagacgattccgttttagaatgtgccgtactgactacttttgatgtagaaggatttggcgaatacattgcactgattccattagataaaaacggcaaaaataagagtggagaaactttccttttccgttatcatgaagaagacggaaatcctgttatcaataacattgaacgtgaagatgaatacatggctgctgctgaaagcttccaaaactttatcgaaaatcttcctcacgaaaatgaaatagacgaagagctggaggaagaaccagacggaaaacaaagtgaagaacaggatgaagatatttttgccgaataaaaacactataatatgcagtctcatcaaaccccaaaagtttccgagactacattcattttaaagggagggaatactttggaacaattacaaatctgggacagtcatgttcatttatttccaccggaaatttataataactgggaaacttatgctgcccgcgactcgtggtttggcgttctgaccaaaaagccggaaaaccacaaaggaaccgaagaagcctgggccaatgccgaagaagcgcttgactgtgccacacaagccgggattcatggtttagtcatgcagggatggtactggaacgatgcgggactgatgcgtatgcataatgactatatggcagaaagcatgaaaaatcatccagaacgcttaaaaggattcatctcaattaatccaaaattcaaaaaagaagccattgcagaaatcgaacgctgtgccaaactcggcttctcaggaatcggagaacttggtcccggcggaaacggctatgattttaatgactctgattttatcgaagtcgtagaatgcgcaaatgcctatcatctgccaatcaatatccactgcggagagccggtcggtcatccttatccgggaaaagacatgacctcccttgcgccgcttcctggcttaattttaaaatatccagatgttacatttattttagctcacatgggtggtggacttcctttttatgaattaaatccacgttatcatggaaagttcaaaaatgtctattacgatacagccgcaaatccactgctttatcacatcagcagttttcgtgctgttattggtttgattggaagcaaacgactgctttacggaagtgattttccactgcttttatatccgtctaaaaacagagaaatggatttttccatgttcgtcaaccaaataagaaacgatgcctgcctttccaaagaagaatggaatgatgtgatgggtaataatttacgacgcgttttagatatttaaacaaaactatattgaatccgaaaaggaacgcatgctgcattttaactgacaacatgcgttccttttcttatcttattttttttatttttctaaactcggaattgcaacttctaagtctacatcctttgcatagtccacaccatcaagatgaaatccaaacatctgataaaaatcctgccaatatccatcaatatctgaaagttctgctacattttctgttgtaacgttcttccagcactccattactttatcctgaacttcatcggaaagctcccagtcatccatacggattcttccctgttcatctgttaccggtttttctacaaataatttttcatgaaacaatcttgaaatctgttcaatgcatccctcatgcgttccctgtactttcatcactttatagagaattgcaaaatacagcggtacaatcggaattgctgcactcgcttgtgttaccagtgctttattgacagaaatataagccttaatatctgaatatttctcattgattttttctgctgtctttgtcagatgacgttttgcctgaccaattgttccatcataataaattggataagtcagtttcggtccaatataagagtaagctactgttacggcattttcagaaagcacacctgcgccgtgaagtgtgtccatccaatccatccagtcttctccgcccattactttaattgtaccttctaattccccatctttcgcaggttctacggtctttgtcacaattgtattatttcttaaatccagacttttttctgtaaatgcttcgccggtcgtctttaaggaagaagcccataccgttccatctgcagttgttcttctaggtgctgccagactgtagattaccatatcaacctgtcctaaatcttctttaatcatttcaacgactttttcttttacttctaaagaaaacgcatctccatttattgattttgcataaagtccatttttttcggcttctttttcaaatgcaacggtattataccatcccggagttgccgtacgttttccatttgatggcttttcaaacatgactccaattgtggaagcctgacatgcaaatgcagctgtaatacggcttgcaagaccatatccggtcgatgctccaattactaatactctctttggtccttctatcgttcctttatcttttacataagcaatctgtcgttttacgttctcataacatcctgtcggatgtgcggttgtacaaataaactctcttacctttggctctacaatcatcttattttcctccgccattttccttttcttctcaaatagtttgattctcaaagtatattatcataaaaaaaaaggaaatgcaaggtttgttttttacttctttcactacccaagcataatttccttttttcttaacttgttacaatttattactgctatttactgtcgcatttatttgttgtacttccaaatccaccatttctgatttccactacatcatcatccactgtgattccatattccacgaaaatgccctgtgcaaatccagttccggcttccacattgattactttgccttcgttggaatcatttgtaattttaataaacatatgaccctcattatccgaataaaaataatcgctgtcaataattcctaccgtattatttaactgtaaacgatatttaaatcccagaccgcttctcgggtaaacttttaaaacccagccttcttccatctgtacacggattccggttggaatcttaatcgtctcctgtggttttaactcaaaagtaagcgggctgaagaaatcatatccggcgcttcctgaagtcgcacgctttgggagcttaacagattcatagatacgttctaattcttcaccggaaatctcaccaaaggtatcctgccatccctccgcaaactgttctttactgactttcataaattttgcaattcgtttcataacgatttatccctccgcatgcagaataatctgcttttctttcaatgatttttgtacatcaatcactctctgattagaacttcctttccatttgagtgccacatttttcttctctatcataaattctccgtctaccagtacatccagataatttaagatttcttcgccttgcaaagactcccataatgcacctgtatacaaccagattgtcttggacggatacttttctttgatttcttttgcaagttttgttacctcagatatattttgtacataaagcggatctccaccggaaaatgtaattccggaaatataggctttttccagttgttcaaaaatctcctgcttcgcagactcatcaaataaaattccactgttcggatcccaggtcacaggattctgacactctttgcaacaatgagaacatccggatacccataaaactacccgaagtccgtctccatttaacatatcatcttttgtgatattatgataacgcatttttctgcctcccgtaaatttaatgtactttcggaatctttctgtgcttgattttgtgagaagattttttgtcaggtatgcccaaatttttgaagcgtacgtttaaaaagggagaaccgcttatcgccatgttctccctctctatgttacttagtcctgacttaaatttcttatgcttcttccggaacgtccttaatactgaagctgattcgtcccatcttatcttttccaagacagattactttcacttcatcacccagagtcagcacatcttctacacggttaattctttcttttgcaatttttgaaatatgaaccatgccctcttttccaggggcaaattcaacaaatgcaccaaagtcttttatgctcaccactttaccggtgaaaatctgaccttctttaaaatcagttgtaataattttgatgtaattgagtgctttatccatcatttctttttctgtgccgcatacagaaactgcacctgtctcatcaatatcaatttttacacctgtttcatcaataattgcattgattgtttttccacgctgtccgactacatcaccgattttatccgggtcaatctgaatctgaacaattttcggtgcatatttgcttacttcttctctcggctttgcaatacatttttccattacttctgtcagaatgtattctcttgcttcttttgtttttgcgattgcttcttcaataatcggtcttgtcagtccatgaattttaatatccatctgaattgcagtgataccatcatgagtacctgctaccttaaagtccatatctccaaagaaatcttccagaccctgaatatctgttaaaacaatataatcatcgtctgtttcaccggttaccaaaccacaggaaatacctgctaccggtttcttaatcggcacacctgctgacatcaaagacatcgtagatgcacagatacttgcctgtgaagtagaaccatttgactcaaatgtttcagatacagtacgaattgcataagggaactcttccggtgccggaagaaccggaactaaggctctttctgctaatgctccatgaccgatttctcgacgtcccggacctcttgacggttttgtttcacctacagagtaggacgggaagttataatgatgcatgtaacgtttggatgtctcaaattcatccagtccatccagtctctgtgcttcagaaagcggagccagtgtcgtaatcgtacaaatctgtgtctgtccacgtgtaaacattgcagaaccatgtactctcggaactaaatctgtttctgctgccagtggacgaatctgtgtgattgcacgaccgtctggacgtttatggtcttttaaaatcatcttacgaaccgtttttttctgatactgataaacagcttcagaaagtacagccagccattcttcattttctgcaaatgcttcttctaatttttctgtgataacacggatattttcttctcttgtctgtttgtcatcagagaatacagcctcttccatttctgcaggaggtacaatctctttgattgctgtaaacagttcttccggaacagcgcagctttcataagcatgcttttcttttccacattcagcaacgattgtatcaataaaagcaatgatttcctggtttacctcatgtgctttaaagattgcatcaatcatttttgcttccggaacttcatttgctcccgcttcaatcatgattactttgtctcttgtggaggcaaccgttaactgtaaatcagaaattgttttctgagccagtgtcgggtttacaataaattccccgttaatcataccaatctgtgtcgccgcacatggaccatcaaacggaatatcagatacacatgtcgcaatagaagagcctaacatcgcaacaacttccggattacattccgggtctactgacataaccatgttatttaatgttacatcatttctataatcttttgggaacaatggacgcattggacggtcaataacacgagaagttaaaatcgcatgctcacttgctttcccttctctcttattgaatcctcccgggatttttccaactgcatataatttttcttcatattctacactcagagggaagaaatcaattccttctcttggtttttcagaggcagttgctgtacacagtaatgtggtgtctccgtaatgaataaatgcagcaccatttgcctgctttgctacacggttgatatcaactgtcaatgttctgcctgcaagttccattgaaaaacatttgtactctttggacatctcttatctccttttctaaactaatctggcagcttctgtccgaaacaactgaaaaaaacagttttatttttacacttataacactttacttttcttaaactgttcttttcagtggtctcggctccagttttgccgcctttgctaaaacagggcggaaaaattccgcccctggttgttactgattattttctcagacctaatttttcaattaaagcacggtatctttcgatatcagttttcttcagataatcaagaagaccacgtctctgacctaccatttttaacagacctcttctggaatgatggtctttatggttgctctttaaatgctctgtcagctcttcaattcttgctgttaaaactgcaacctgtacttccggtgaacctgtatcacctggtgttcttgcgaattctgccataatagcctgtttcttttcttttgaaatcattttaatttcctccattcatctttttaatcgcctgtaattaagaaacggtcggagtgtccggtttctgaactacggctgaactcatacttgctcagtatagcacaagatatttcacttgtaaagtcctattgtgttacaatttttcatgtaaatctgcaaaaaattgtcttccttttgccatatcaatatcaagctgtccctttaattccagaagggatgcaaatttacgttccggacgcagataatgataaaatcttacttctgcttcctgtccatataaatcttcattacaattaaacaaatatgtttccacacccagaaagttttcttttaccgttggtttataacctacattggagattccatcgtactctttttctccaattttagaacgagtcagataaactccgtttggcggaaattttttgctgactggcggaatcagattcgcagttggtactccaatcgttcttccaagctgtcttccatgcacgatctctcccctggtaaaatactgatatcccaaaagagcatttactttttcgatgtgtccctcttccagctcttccctcacataagtactactgatttctcttgtcccgtctgtcagtttttctacgacttccaccgtaaaatcatactgtgttcccatctgttttaataactcagggtttccttttctttcgtgaccaaatcgaaaatccggtccaaccgccagataagatacatgcagacgtttcaccagaaattcttttacaaattcttctgcttccatattcatcacagcatccgtaaacggacacgcaatcaaaacatccactcccagattctctgccagttcctgtctttcctcattggttaaaagagtctttgccggtttatgatacagcttcacaagaggagaaacatcaaaggtaaatacgaccgttgtacagttttcttttttcttttgtttcatgcacgcaatcagtttctgatgccctctgtgcaatccgtcaaattttccaagtgtcacagcacttctctcttgcgctttcagtacaggcacttcgtttgtgtaaatcataatgtctcctctttctgcttctaaaaatcctgcggtgtaaaaaagatggtgtgcactccaaaacattcccgtcttttttgatactcataaataccgataaaatgtctgttgctgtcatacatgcgcactctcgttttatccggcaggttctgatgtgttattgccggtactttatttccattatgaagcagtttatccatttctttcggcactacaacctcttcataatgagaaaacatttcttctattgttacaagatgagtatcaaatgtccccgcttttactgcagcctcaatcgcagaaagtttcatgctgtcttttaacataaaacgttctacctgcgtacgcagaagagattccatacaacctccacagcccagtttcgcaccgatatcatggcataaggttcgtatgtaagttccctttgaacacgttactgaaaaacgtaccaatggcagattcatttctaaaatcttgatttcataaagagttacttttcttggttttcgctcaacttcttttccctctcttgcaagttcataaagtttgcgtccgtttactttcaaagcagaatacatcggaggaatctgctcctgatctcctaagaaacttaaaattgtacgctccacctcttcgtctgtcacacttaccggatgttcttctaacactttaccagtcatatcctgtgtatctgttacaattcccaaccgaagaactgcctcataagtctttgttttatctgtcagcaattcacaaagctttgtcgcttttccaaggcagaccggaagcacgccttctgcttcagggtcaagtgttcctgtatgaccgatttttttctgtcttaaaattccacgaagctttgccactacatcatgagaagtataacccttttctttgtatacattaattactccgttaatcactgcattttttcctttatttctttttcaatctgttttagcagattattcataacatcgtaaatagacccctgcatcgtgcatccggctgcacgtacatgaccgcctcctgagaaataagatgctattttatttacatctacttttgatttggaacgaagacttactttaaattcctgtgtctttgtttcataaataaacacagccacttccactccacgggtcagacgaagctgttctacaatgccatctaactcttttgggcctactccgtaaaaatccaaatctctttttctaagacaaccaatgatgcattttttatctaacacctgaatgctttccatcaggcatcttcccagaatctgattctgcacatagcttttttcatagaaagactggtcaatgatactggaaaaatcaattcctttttccatcagctttgccacaacccgcatggtttccggtgaagtacaggaatatttaaacacaccggtatcgcttgcaattccggtataaattgcttctgccacatcttttgtgattttttcttcttctaaaaggtgaaacaacagttctgatgcagaactcatttcaggttcaatcagattttcatctgcaaacccgtgattactgatatgatgatccagacagatcgtcttctttgctgtttttaatgcttctcctgcaactccaattctgtccggtgaactgacatctaaaagaatcaacaggtcatattccgcctgtgaatcatattcctgttttgcttcttccagatttttgatataagaaaatccttcttttgctgtttccaaatagacatcacatttgatatccagttcattttcttttaaatacaggtataatcccatacaagaaccaatacaatcgccatccggacgtacatgtccggcaatggcaactgttttaatacctgctaatttactcgctaatttctccatcttcctgcacctccccagctgcatctttatgtgttacttcatcaattaattttgacatagaaactccatattcgattgattcatccaggataaatcggatttccggtgtatttcttaagtttacagtcttagcaagctgtcttctgatataaccctctgcacttcttaaacctgcaatcgtattcttttttgcttcttcatcacccagaacactaatataagctttacaggtttttaaatccggtgctacttccacagaagtaacagaggtcatcgggtgaatccgcgggtctttgatttccccacggataatctgtgcaagttccttatgaacttccgcatttacccttgtattcttaatactgttttttctcatttataaagctctcctatcttggtacttctaccataatataagcttccactttatcttcttcctgaatatcgttaaagtcctcaaatacaagaccacattcatatcctgcttttacttcttttacgtcatctttgaaacgttttaaggaagcaagatttccttcataaatctgttcttcgcctcttgtaatacgaactttacagtttctctggaagataccgtctaatacataaccacctgcgatagtaccgactccggaagctttgaatgtctgacgaacttctgcatgaccaattactttttcttcgtatacaggatcaagcatacctttcatagctgcttctacatcttcgattgcctgataaataactttatacagacgtacatctacgccctcctggtctgcaattgtttttgcagtcgcatccggacgtacattaaatccgataatgatggcatttgatgcacttgcaagagaaacatcagattctgtgattgcaccaactccaccgtggattacttttactacaacttcttcattagaaagtttaacaagactctgttttaccgcttctacagaaccctgtacatcggcttttacgataattggcaattcctttaagttaccggcctgaatctgggagaataaatcatccagagacatttttgcttttgtttcttcaagcagacgattcttgttttcagaaacaaaggtagcagcaaagcttttcgcttctttatcattttctgttgcaactaagatttcacctgcatttggaacatcgcttaaaccaagaatttcaaccggtgtagacggacctgcctcttttactctctttcctttatcatccatcatcgcacgtactttaccagagcatgcacctgctgcaatggagtcaccaacttttaaagtacctttctgtactaaaattgttgcaaccggaccttttcctttatccagttcggcttcaataacaagacctcttgctcttctctttggatttgcttttaattcttctacttctgctgttaacagaatcatctctaagagggtatcaattccttctcctgtgtgtgcggaaaccggaacaaagattgtgcttccaccccagtcttccggaattaattcatactcggataattcctgttttacacgttctacatttgcgcttggtttatcaatcttgttgattgcaacaatgatttctactccagcagcttttgcatggttaattgcttcaattgtctgaggcataacaccatcatctgctgcaacgacaagaattgcaatatctgttgcatttgcaccacgcatacgcattgcggtaaacgcttcatgtcccggtgtgtctaagaaagtaatcttctgtccgttgattgttacaacgtaagcaccaatatgctgtgtgataccacctgcttctcggtctgtaacatgagtatttctgatacagtcaagcaaagaagttttaccatggtcaacgtgtcccataacacagacaaccggcggtcttgaaactaagaggctttcatcttcctcttcttcttttaagagttcttcgatgacatcgattttttcttccggttctgcaataatatcataatcgagtgcgatttcctgtgctttttcaaaatcaatttcatggtttactgtaaccatgataccatccataaacagtttcttaacgataaccgatggctgcatcttcattttttcagccagttcacggattgtcattttttccggaagtgtaatttcctttacttcttccttcttttcttctactttcggctgagtacgtggtttctgaagtgcttttggaagtctctggtttggtcttcttcctccaccctgatttggacgttttccgcctttgttattattctgatattcatctttacgaacatcttttttcttattgtctctgtttgccttacggctgtctttttctacaaactctaacttcggaacttcaaatttgcttcctttgtcattatttctgaatccaccctgacgattgtcattgtttcttactccgccctggcgattgtcgttgtttctgaatccgccctgacgattgtcattgtttctaaatccgccaccctgacggttttcattatttcttggtccaccgccctgacgattgtcattgtttctgaatccaccttggcgattgtcgttgtttctaaatccgccctgacgattgtcattgtttctaaatccaccctggcggctctcattatttcttgagccaccctgacggttctcgttatttctgtatccaccctgacggttctcgttgtttcttactccgccttgacgattgtcattatttctgtatccgccctgacggttttctccacggttctctccgttattatagcggtttggacggtcccctgtatttccctgacggttatcattgtttctataatttctctgacggttatcgcctgtatttcttccctgatttcttgtctgtcctgactgttcatgtctgttttgtgtattatttgtattttccgttttcatgcctccctgtaccggattttctctctccggctgacggcttcctgcttttttctccggtttatgacttgcattttgcggacgaaaaacctgaatcagttttttctttggcttttcttctgattccggcattgcagcagctgtcacattcccctttctaaaatttgcccgtaccatttctgcatctttatcttccacggtactcatgtgacttttcacatctatatttttagatttcaaaaaatccattacgtctttattggtttttccaaattcttttgcgagttcatgtactctttgttttgacatatacctgcctccttcatttagctacctgcctgctctaacttttttgtcatggcctttgcaaaattttcatctgtcactgcgattaatgcccgatactcttttccaatggcccttcccaattcctcctttgttccgatatcataaagcggtacttcataaaacacacacatatcatgagcacttttctttgtattcttagaagcatcttctgctaccagtacaagatgtgcttttccctctttcacgtatttttccacggcgaactcaccgcttaccactttcccggctttcattgccagcccgagaagagacaattgtttatttagactcaagtttatcaaactcctttttgaggctttcgtatacatccggtgaaatcggcattttcaaagaacgctcaattcttttgtttttttctgccttttccagacattctttctgaaaacaaagataagcgcctcttccgtttttacgtccggtatcatctaataccactacgttttccggagtctttaatacgcgaagcatttcttttttatttttcatttcaccacaccctacacatttacgcataggaatcttttttactgtacccatgttcacctactcttcttcgctgtcaaaaacttcactatctgcttctgattcatattcatcagcggattctgcataatttttatcttccggatactcttcataagcttcttcgtaaagctcataatctccaagttcgcttgcctgtgattcactcttaatatcaatcttaaatcctgtcagccttgctgccagtcttgcattctgaccttcttttccgattgcaagtgataactgataatccggtacaattacctttgcagtttttgcatcaggatcagccaatacagaaataacctttgccggacttaaagcattttcgattaagagtgcaggattatcactccagttgatgatatcaattttctcaccacgaagttcttctacaattgcattgactcttgctccgttcattccgacacatgcacctaccgggtctacatccgggtcattgctccatactgcaattttggtacgagaaccagcttctcttgcaatactcttgatttctactgttccatcttttacttctgttacttctgcttcaaacagacgttttaccagctccggatgggttcttgaaaccataatctttggtccttttggtgtatcttttacttccacaatatagaccttgatacgttcagtcggctggaatacttctgtttttacctgttcattttcagaaagaatcgcatctgcttttccaaggttaatgctgtaattcttgccaaggcttctctgaacaataccggttacaacatctttttcttttccataatactgattgaaaattacttttctttcttcttcacggattttctgaagaatcacattttttgcattctgtgttgcaattcttccaaactcttttgatttaatttctacatttaccgtatcacctaaatcatactgagagttcattttctttgcatcttccaggctgatttccaataccgggtccaatacttcttctactactgttttctctgcaaatacaccaaactcacaagtctgcgggtcaatatttacttttatattatcagcttttccaaaatggtttttacatgcctgaattaaagactgttcaattgcttcaagcagggtatccttgctgatagatttttctttttcaagaacgttcagcgcctctagtaactcagtattcattttttatatcctcctaaatcttctctttttctttaaaaatcaaatgccagacgaatcagtgcaatatctgatttctgaaaagtctgttcgccatcttcattttcaatggtaacactgttttcatcataagattttaaaataccataaaactctttttcacggttgattgcacgatacgttctgatttccagttcttttcccatgctccgtttgtagtctttttctttctttaatggtctgccaagtcccggggaacttacctccataatataagcatcatcaatgaaatcctcttcatccagtttatcggaaaatgcacggcttacgacttcacagtcatccactgaaattccaccttctttatcaatataagctctgagataccagttacttccctcttttacatactctacatctaccagttcaaaattgtttgcttcaataatcggaagcagtaatgcctctgctttttgttcatagacttctttcttgctcatcttttcaccttctctcccattttccgttatacaacaagagtggaccttttcggtccactcttatgctatcgtagttatcaagttctttatcagcataacactattattcccaacttgcaagtcttttttaccaatacaccgtaatcaaaagctctgcatcactgcatccgacgttccacctgtagctgttttctccatcaaaagagtaaaactcctgaactgcctgttcaatcagatttccttctgcaagcgcactgactgcctgctgataagcttcttcatttgcaaacttaaaatcttctttttcccgtttttctaagatagaagcttttagtacctgataaatctgtgattcatcataagactcataccagctctgattctgtttataataattatagctgtcatctttacattccggaagcgtaagattgtcatccggtacatgacttctctccagcgtctgtgcagtacaacacagatatgtgtaagagaaatcctgaatactatcctcttccggcacaaatccggaactgctccaggtcgtatctacataataataattttctcctatccgcaccagattccatgcatgctccatgttttccggaataacttttccagttaccaaagtacaaaagattccatttcttacaagcagatactgtgtcgctttggcaaatcccatacaaaccgtactttgatttaaaaatacactctggatattctgattgttttcactctcactgtcataaagcacattcttcccaaggaactcataaacatacttaattttatcatattcgttttcacagtttgaaagttcctgtgaccattcctctgcttttgcttctatctgctgttttgtgtcttcaatctcatcttttcccatgttatagaccagattcaattccagcaaatccacatcggaattttctttttgattaaacgaataattctgctgttccagccagaaaatttccggatggtctacaaaaaccagattactgactttgttaatctcttcttccgaacaagcctcgacagtcacagaatcttcataattttcaattcccgcaagaatctgacggtatcttgttttttcttcttcatttaagttctgatacccataaagaaacggctcttcttccggtgtaatctctgcctccggaagtgtatcctgttctttttgtacatcactgcttgaggaaatcggtatcttgtcttgggtacatccacataagctaagtatcagaacaagtgtaaaaattccaaacctgtttcgttttttcatagatgattcctctcaattttttacactcttgtctttgttccttttccatctctctttgccagtttcagccgatttaatgaaacgctcttgcccttataatccgccgtataatctgtccggttttctaacaaatacgcatgctctacttcatcttttgcgcccaatgtaattcctcttactccaagtgctgcttttttctttaacggtacttctgttttcataaaacgtaagaaatatccctcttttgtctgaagtactacatattccatttcatctgccggttgaacgaaaacgactttatcaccctctgccagctttgttgctgttgttgtcctcttggaaacctcaaattcagaaccttctactaattttaccattccaaaagcagttgcaaaaagcatccgactctgcttaatctgatttaaactttccacataaaccagctgctctttcttgctgtcaaaattgctgacattatcaatcggaactcctttatctctcatttttccataaggtaaatctaacacttttatagtatgcagacatccggtatctgtaaatacacagattttatcggtattcatacaatggaaaatatggcggttttcctgatgaatggtttctttatttctttcataaaccgactgatctaccgtttttgcatagccaaaacgatccatcaaaaagacaacttctgcttcttctattttcttttcttcgtacaccgcttctttggcattttctatctgtgtttttcttggttttccataggctttttttactgcctttaattcttttataatcactgccgccatggaatgataatgatttaagatatcctcatactgtgcaattttctttaaagtctcttcgtgttctttcgtcagtgcttcaatttcaagcccgattaatttatacagacgcatgtctaaaattgcagttgcctgcttttcggtaaatccaagttttttcgcctgtttttcactggttttcgtgcggaaacggattccttctgttgctccgtttaccagacagtttttcacctgttcccgatttttactgcctcttaaaatttcaataatcaaatcaattacatcgcaggctttgattaatccttcctgaatttcctgtttttctttttctttggaaagcagggtgttatattttcgtgttgtcacttcaaactgaaaatccacatgatactcaataatctgctttaaacttaaagtctccggtttaccatttgcaactgcaagcatgttgaccccaaacgtatcttccagacgtgttttcttatatagcatattggtaagattttcaatatctgtaccttttttgagttccaatacaatacggattccctcttttgaggactggtttgagatatctacaatatctgtcgtctttttggattccacaagccctgctacatcatttaaaaattttccgatgtttgcaccaatcatcgtatatggaatctctgtgataacaagcaaatttcttcccgctttgcctttttcgatttccacttttccacgcagcttaatctttccggttcccttttcataaatcgaaagcagttcgtctttattgactacaattcctccagtcggaaaatccggtccctgaatatactgcatcagttcttcatttgtaatttcgttgtttttcatataggcaatgacgccatctaccacttcatttaaattgtgaggcggaatacttgtcgccataccaaccgcaattccgtctgctccgtttaaaagcagattcggaacacgcaccgggagcacttccggctctttttctgtctcatcaaaatttgaaacaaagtcaaccacgtctttatctaagtcatttaaatatacttcctgtgtaatcttctcaagacgcgcttccgtataacgcatggctgctgcgccatctccctcaattgaaccaaaatttccgtgaccatctaccaaagcctgtccctttttaaattcctgtgccatgacaacaagggcatcatagatggaactgtccccatgtggatggtatttacccatcgtatctccgacaatacgggcacatttacgatacggtctgtcataacggattcctaattcatacatatcataaagtgttcttctttgtacgggttttaatccatctctgacatccggaagcgctcttgatacaatgacactcatcgcataatcaatatatgatttctgcataatttccgaatattcagttctgataatattatctgcgtttgccattttctttccccctatacatcgagttctgcatcttgtgcatgttcatagataaatgcctttctcggcggcacttctgttcccatcaggatttctgtaatatcagatgccattcttgcatcttcaatttctactaattttaacaatctggtttccggattcaaggttgtctcccacagttgctgtgcatccatctctccaagacctttatatcgctgtaaggtaaaggcacctttatgtgtctttcgataacgctccaatgccttatcatcgtataaatactcttcttttcctcttgccggcatcgctttatataaaggcggcatggcaatatagacatgtccctcgtaaattaattccggcataaagcggtaaaataaggtcagaagcagcgtagaaatatgcgctccgtccacatcggcatccgccatgataataatcttgtcatatcttaacttcttaatatcaaaatcatttccatatccttcggaaaatccacagccaaatgcgttaatcatagtcttgatttccgcatttgccagcaccttatcaatgcttgctttttctacatttaaaatctttccgcgaatcggaagaatcgcctgaaaacttctgtcccttgcagtttttgcacttccacctgcggaatcaccctctacgatgaaaatctcacagatagatggatctctcttttcacagtttgcaagttttccattggaatcaaaagaatatttctgttttgtcaacagattcgtctttgctttttcttctgtttttctgatttttgcagatttttccgcacaggcaagaatgtttttcaaggtttcaagattacgatccatatataaaaccagttcttctccggttacttttccggttgcctttgaagcgtcctgattatccagttttgtcttcgtctgtccttcaaatcttggagccggatgcttaatagaaatgactgcagtcatcccatttcgaatatccgagccggtaaagtttgcatctttttcctttaaaattccaagttctcttgcataactattcattacagaagtaaaggttgtcttaaatccggtcaaatgtgttccgccttctgcattgtaaatattgttacaaaagcctaagacattttcacgaaattcattgatatactgaaatgctacttctaccgtaattccatccgattcacctttaaaataaaccggctcatgaatgacttcacatttcttattcatatctttaataaatccaacgattccatccggttcatgataagtaatttcttcgacttcttcacctcttttatcactaaaatgaatcgtaagattcgggtttaagtatgcagtctcatgcagacggctctttacttccgtcgctgaaaatttggttttttcaaagatttcaggatccggtaaaaaatttacctctgttccggtttcccttgtttttccaagagttggaagcagcccatcttccaactcaattgtcgggatacctctctcataatggtcatgatgcacatagccttctctgctgactttgatatccaaatacgtggataaggcgttaacaacagaagaaccaactccgtgcagacctccacttgtcttataagcggaattatcaaatttacctcctgcatgaagtgtcgtaaataccagtcgttctgctgaaattcctttttcatgcattccaacaggtatgcctcgaccattatctctaattgtagcagaaccatctttttcaagcgttacaaaaatattactacaatatccggcaagatgttcatccaccgcattatctacaatttcgtaaatcagatgatttaacccttttcttgaaacacttccaatatacatacccggacgcttacgcaccgcttctaatccttcaagaactgtaatactactggcatcgtaagtattcttttttgccatttctatttcatttcctttctttttctgtctttattttaatttttctcttcaacacctcttgatataccacgcctgcaagcagtccacagattactccaattccaatccctgctaacacatctgtcggaaaatgtacatataaatacaatcttgaaaatgcaatcaaaactgccagaataaatgcacagactcctgcttttttattcacatgaaagattgccgttgcagaagcaaacgatgcctgtgtatgaccagacgggaacgaataatcttttggcattgcaactaaaaggtgcaccgattcatttatccagcatggacgctctcttgcaaccaatggctttaacatcagatttgcaaaaagtgcagaaaaacataatgccgtcaaaatcaggattcctgtctttctgtatttttttgtaaagagtaataaaactcccaaagcaatccagaaccatcctgcatctcccaaaaatgtcacacctaccataagtttatctaaaacaggtgtatgtatgcattgtaatgcatcgagcaatgtaaattcccagctcatttttctcatttcctttctcttaaaaatgccgctgattctatgttcagatttttacgcgctatttttctatcatatcctatttcgtcttgtttttcaatttcaaaaattgtatggattaaaatacaatatttttcaaaaaaatgcttgcttttttattattttatgtgtattataagtgagtacggttcgttggtcaagcggttaagacgtcgccctctcacggcgaaaacaggggttcgattcccctacgaactgctgagttgaaagcatgaagaattagtcttcgtgctttttttatgctttcttttcccttttattgacagtcttattatcctactatacactatacttagtgtttattttatataaaaaagaagaaaggattttttattatgtctcaatcgaacacaaatgaaaacaaaatgggcgtacttccgattccaaagcttctgcttcagatgtctctgcctatgatgctctctatgcttgttcaggcactttataatgtagttgacagtatctttgttgcccgcattaatgaaaatgccctgaccgctgtttctctggtttttccggttcaaaatctgatgattgcaatcgcagtcggaaccggagtcggtgtcaatgctgtactgtcacgaagccttggcgaaaaagattttcatactgccaatgaatcagccaaaaatggaatctttctggcactcatcagcagtattatttttgcaattctaggaaatattgcggcaacctttttctttcacatccagaccgatgatgctcaaatccgccagtacggtatttcctatatgaccatcatctctacgatgtgtattgccgtttatatgcaggttatgatggaacgactcttacagtctaccggccgtactttttacactatgatttctcagggtacaggtgcaattattaacatcatcttagacccgattttaattttcggattatttggtatgccacgccttggcgtttccggtgctgccattgcaactgtctgtggacagatttgcggagcacttttagcctttgcctttaacatcaaagtaaatacagacatcaacctgaatatgaaaggcttccgcccaaacaaaaaaattatcggtacgatttattcggttggtgttccatccattgtcatgcaggcaatcggttcggttatgacatttggaatgaacaaaatcttaattcagtttacttccactgccactgcagtctttggtgtttactttaaactcaacagctttatttttatgccaattttcggtctcaataacggtatggttccaatcgttgcttataactacggagccaaaaacaaaaaacgaattacgcacacaattcgcttaagtattgtcagtgcaatctgcattatgcttttggggcttgcattatttatgatattcccggctcagcttttaggattatttaatgcttcaggctctatgcttcaaattggtgttccggcgctcagaattatctgcttaagtttcacctttgcaggattttgtatcgttgtcggttctgtctttcaggcacttggaaacggcatatacagtttaattatctctgccacacgacagcttttaattattcttccagttgccgcactgcttgcaaaacttggtggtctctccgctgtctggtgggcaattccgattgcagaaattgcatctgttcttttaagtacatttttcttccggaaaatttataaagaaaaaattgcaccacttgggaaagcttaatattttaaactaaaaaactgctgttaagttgaacgataacttgacagcagtttttttgattgaatttggctgggtgtcaagtagcagtcagttccaaaatcaatatgaaccataccacctacttcactttttcattagcttatcacaagtttctgcctgttcccttaatacacgaatcagcagctggtattcactgacatcatcaaaaataccattgcagaggtcttttattgcttttgcctcttccaggacttttcaatcctacttaaggtatcctcactgcggctgtggtagataaatagtagtatcatttgtaacaaaagacatcgtaagacctcccagataagttctggttatattttaacagataatggatgatatgggtatggtatcatgtgttaaattttcaaggtacaaatctaactgaataggtacgagcttttgacgcttaaatcattatatagtaatatatttaaaaagcttgaccttaaataacaaaatatggtatatttcaatcagaggttttgttgtatgcaaccaatgttagtctagtataactacgtaaattttttattataaaaatactagtgacaaaattaaatttgtcactcacatcttattattaaatataagcacaaatacaaatattagtagctgaaatattaaaaagattataaatgaggtcattatgaaaaaaaaacttgcagtcatcatcatttttatatttggaatatttatagtagtaggaaacttgtgtaaaccaacagatttcagtatagaaggtaaagttatagaaaaatatgagaaagcatttctgttagaaacagatacctccgataaaatactttgtaattgtccgaaaaattatgatatttcacaactagaaatcaatgataaaattacggtttatttcaatggtaaaatcttagagacttatcccgcacaaataaaaaaaacaaccaaaatcaaaaaataattaaaaattcttgcaaacaagagaggaggttgtatgaaacaaattcgattactttttcttggagtgatacttagtattatgacatctataagtgtatttgcaaatagcaatgtggtagaaaccgaaatcgaacaaaaaaattgtcaggatataagcaaaaatatggaaaccggagaaattcttttaaatgagatacctacaactttaaataatcccagtagtggaactacagattcttttataccaagtggaataaaagaagataagcctttaacaagagaaatcattggaaaagataacagatataaaataacagatactactacttttcctaactcagcaatttgctatgcagaaatgaaatttcctaattcagatagcatttacgttggaactgcttggatgtatggcaatcgtgttgcagtaacagcagggcattgtgtatatgactcatcattaggcggatgggctgaatgggttagaatataccctggaagcaatggaagtgaatctctatatggagtctattatgcatctgtgttacatactgatactaagtatgtaaagtcagaaaattccaactatgattgggggcttttagaattcacttcaaacataggctctcaaacaggatactttggtgcttcatggacaactgacagtttagtaggaacatgggttgtattaagaggatatccagcggaaaaatctgcttgtttatggacaatgagtggaaaaattgcaaccagtggtacttttaaattaggatattatatagatagtacaggcggacaaagtggctcaccaatatacaaagtaactaatggaaattatcaaagccttggcattcatacaaattattcacctacaaatgaatataatgaagcagaacgaattgataaatcattgtttgaaatcatgaatcaatatagataagatacaatatattaatggttgttgtttgcaagaattgattattcaaaaattctgaaatttgatgctacatgttaaattccagaatttttttgtataataaaaaaggtaaaacattagctgatgctaattaatatcactaatgttttacctttttatcataccaaaatccagaaaaaaataatttctgcacactacttcttactctgcttactctatttttattcttccggtgcttctgccggaacgaaaatccgtttatctgccgcagtttccggcagtttgatttttgctcttctggttgcttcttcacagaaaaagtcctgtgaatttagcagcattttgcctcgtttatctactttctcatacgtgccatccggctgaagaatatgtgcttttacattatcttccaattgaatctgtaagatatgtttcacttcttcttttaactgttcatcttctaccggaaatacaatttcgacacgtttgtctaagtttcttggcatccagtctgcacttcccataaagatttcttcatttccatcgctgtagaaataaaaaatccggctgtgttccaggaagtttccgacaatcgaacgcacggtaatgttttcgctgattcccggaattcccactttcagacagcagattcctcgtacaatcaagtcaatctttacacctgcggcacttgccgcatataacgctgcaataattcctctatcgcaaagagaattcattttcgccacaattctggcttttcgtccttctaatgcattttttctttcgatttcaattaaatgaagaaatctgtctcgcatccagagcggtgctaccactaatttattccaggttcttggttctgaatatccggaaagcatattaaagactgccgttgcatcctctccgattcttgctgaacaagtcaagataccacaatctgtatataattttgcagtcgaatcattatagtttccggttcccagatgcacatatctgcgaattccattttcttctcttcttactaccagtgtaatcttactgtgggtctttaatccaatgactccataaataacatgacagcctgctttttcaagcatttttgcccagacaatattattttcttcatcgaatcttgcctttaattccaccagtaccgtaacctgttttccattttctgccgcctgcgcaagcgctttgataatcggtgaatttccgctgacacggtacagggtctgtttaatcgccagtacattcgggtcttttgccgcctgctgtacaaaatctacaaccggatagaaggtcatataaggatgatgcagtaaaatatctccctgtcgaatctgggtaaagatatcctcatcattcatcattgccggtacctgtgccggaatgtatggttttgttttaaattcatcaaaacccggaagcccatacattttcatcaagaatgtcaaatccagcggaccattaatcttgaagatatcctcatctttaatctgaaattcctcttccaaaatctttaacagtctctcatccatccgctcttccacttccagacgaatgacctcaccccactgtctcttctttaactgtttctggatttcctttaataagtctgctgcctcatcttcatcaattgtaaggtctgcatttcgcataatccggtaagggcaggtacaaaccacagcattacttaaaaacagtttattgatatttcgctcaattacttcttccagtaaaatcacaaccgtatttccatctttatcatccggaagctgtacaattcttggaagtaccgatggcacctgaaccgttgcaaactccaactcttctttcccttttttatcttttttggaaattaatgcaccgatatttaacgttttatttcgaatcaatggaaatggtctcgcagaatccatcgccatcggagtcagtaccggatacacttcatcttcaaaaaaggtatcgacaaactcctgctgctctttggttaagttttcatgatgctctactacttttaaaccaatctttttcagtgccggcaaaagagaacgattgtaggtattgtactgtgtatctaccagttcctttgttacttttgaaagtgcttttaattgctcttttgcagtcattcccgcaatatccgttttggtatattttgcatgcaccatatcttttaaagaagcaacacgaatcataaaaaattcatctaggttcgatgccgtaatactcaaaaattttaatcgttcaaacaacggcagactcttatctctcgcctcactcaaaacacgctcattaaattttacccagctcaattcacggttagtataatattccggctttgtatattctttttcgttccattgcattttttccacctactttctctttttccgacgtaatacaggacgaatattgaacatttctttaaagaaatctgctttctgtgtcagcagcccctcctccaacaataagttttcctgtgtatcaatcacaagtaccagctctttatcctgaagctgtacttttacattctctgctttttgtttatggcttcgatccaatgcatttgccactcttaaaatcgcagtcagctttccaattaccatatacgtgtctcggtcaatggtactctttgaatccgcttcgccataatatttaaatggctcattgttaaaacgcactatatttgcaatcatctctcgctcagcgtgcgaaagcccgataatttcggtcgacataataatctcatacgaacattttgcgacctcactcatactgatatattttccacaatcatgcaaaatgactgcaatctgtaaaagcaggcgctctcttggtcccatcccatgcactcttctcatactgtcaaaaattgtctctgcaacctttaacacagcacgcacatggctcttactgctcatataacgctttgcaatattttgtgcacaagctaaaatatcgttttcaaaattatgggtactacgaatcaaacgtctgccctgtgcataatcataagcaattccgtcatttagctgtgttcccggaacccacagattctgtgcccccatctcatctgcaaaaacacgataaatgatcaaagccggaaccaggatacttgcatattccagtgtaattccaagttctaccgataactgctctgcggatttatgcacgattcgctcatacatctccataaaaactgctttactaacggtacgactctctcccattccataatcgctcaccagcaatttttctataaagaaatcgcccaataaaataatattatctacttttcgctcttttaaatgaagtttcttaaaacttaaaatgtcattatgaattaactcttctactaatttttcataataaatagtttctttttcgacagagagcagacgctcacggatacgaagacttcccatcttaaaattctgagttgtcacaagcgtatctttatcaaataatgaaatctgtacatttccaccgccgatttctatgattgcagtccctttctgaatgatttttgaaaaatctgcttccttagctgcaatcgatttatatccaaaaaatctctgctcagagttacttaaaatttcaactcggattccggttctttgataaacctgctccagtacgatccagacatttcttgcttcctgaagggtacttgtcgcacatgcacggtaagaagtcactttatactctttcataattctggaaaaatctccgagtacttcgcctaatcgctgtgcagactcataactaatttttccattggtataagtgtcatgtcccagctcgattctgctacgcacttcatctatcttttcaattccaatttttggagaaatctgatagatatccatactgacttcgtaagaaccgacatcaattgccgcaaatattgttactgccatttttccaccgccttacattagtttgctgtttaattatatcgttgtaagttgttgttttcttctaatctctgttaaattcaggtaaattttcttgaaaattcgtcttttttgtcttttagttctcaagatattcttttagtgcttcataataattctgtgcagtttcatatccatcttcatatagtttgtgcagcttatccgtatctctttcaagtcgtccgatttcaaccggtttttgtggctgtaaaataaatatttttccctctttttcctgacggtataaataatccagtgtctgattatacccaatgtggcggttttccaaagcttctatcagttttggaaacttctttccataacggactttcattgcaggaatcaacttatttttttctttcctgtaagttctgtcacgagtcagtaccactacatttttctcatttcccattctctgagcttccataatcggaatggaatctgtaattccaccatccagatacggctttttatgaatccagaccgttcttgacataagaggaagcgaacttgacgcacgaacataacaagtgtcttttttcatatctttgatttctttgtactccgcattcccactttcacaattggtaacaaccgcataaaatttggttttttgtctgttatatgtatcgtaatcataaggattcaatttttctggaattttacggtatatcatatccgtgccaaaataatctccggtctttatcaggctttttattccacaatattccgggtcatccatataatcagtaaatgtatggtaccctctgcctttttgtttagaaagataactgcatgccatacatgctcccgctgaaacaccaaagcaagtatcaaattccagacctttttcaataaagaaatcaagaattcccgcagtgaatacaccacgcataccgccaccttctaaaattaatcctgtttttgtttttttactcatgctgtcatcacctttttttattatttatttaaaatcattttacgctttttgtaagatttgtacaaggtaaattcttgtaaaaaaaagaaaccggccggggccggtttctgatgggtgaatattagaggtttggttttgtagatgcttttacatgtctgttatagcgttaagaggtaagagtagaacttacatttcatctcaatcctctcaattccgctttctgttcttccgtaattcgattgctttccatcgctttttgaattgtcttcctatgcacccattccggcaacttccggtcttttagatatccaatcacagcctcccattgctttgcaagcgcagtcgcaaaataccaagcaatcatcatattgacataatattcgtccgaaatcacagctgagacaagtttcggatattcatctttaaaatcttcatctaaatacagccgtaatagcactccaattccataccgaatggtatacgtatcatttgaagcaatccaattttttacatccacaatcaattccgctttgtgtttttcaaaacattttggtaagggtaaatcacaggttgcccaattatcaatatagggtaaaaattgtgtcacttcttttaaacattttttgtagtcgcaaatctgtgtcacaagcatcaaatgtaaattattttcctcgtaatactgatgaggaagttcttgtaaaaagttttgtgcttcttttgtttgggcaaactctttcgcaaatttacgaagaatcggtgtacgaactccaatgattttttctttttctgtcttcggtaacaacttgctttgaaaatcacgatattttaaatcttgtagttcaaataaacttctttgtagttctgtcatatgttgtttttttacctcgtctctgctttctgaataataaaggttgcagatgtgttttgattagatgttgtatttctatttcgttcctttttttacagatgcatttctattattttattaatgcaaatgtatctttagtttaggtattcttaagttctgaggtacttttggcgaactcgaataaaaagaactgatggaataacaaaaaatgagtttcaatccctcataggtaatatacaacaacagtatttccgccatttctaattctcattatcctctaatcacccattttttgcaagttttttcacaaaaagtcagtcaatctctttttagaaatcactcattttccttgattttacaacatttcttagaaatcgccaaattcaccttgagactgaccgactttttaattccttccttttattttgcttaagctaactttctttccttaacaataatgaatcccatcccagtaaacacattcttttactatcgtctccggcagaaattctaccccttttaaagcatactccttaaatttttcaaatccaactctatcaataatatatccaatatgctcttttctcgcaggtgcatccggagagatatactcttcaacaaatttatacgtattcttaataatcctaataatgttttcttcatctgcccacacaagaaaatcctgtccaagtcttggatttttctttccggttcttcccataatggataatttgtaatattttttcttacttcttgtccatgctctggtcggacattttgtgacacagaccccacagccgatacatttttgagtatctctttcaattcgataattttccatacgaagtgcgcccactgacaaactgttacagccttttatgcacgcctggcagctgacacagcgggctgcatcgtactgtggcattgtcattccgataattccaaaatcatgcattcttgcttttgcacaatcattggaacagcctgtacatgcaattttaaaatgcaggtcgtttggaaagatttctttatcaatttttcttgctagttctgctgtattataattagcaaatggacagacattattcccaatacatgcctgaatatttctggtcccagatgcttcgtatcctttttcacgattcgtttcagcttgatttgtttctaccagctcaataatcggctgaagtttctgatttactacttccatatcttcaagatggattccttctatctcaaatccctgtcttgttgttaaatgtacatatccatttccatattcctttgcaatctcctgtaccattccaagcacatcggcatttaaatatccgcctggcacacggattctggatgcgccgattcctcgttcttttgtaattctccaggcattctttttcgctttttttgtattgatatccaaactcatttcgcttctcctaatctatcaattccctggcttctgtataattaaataccggtccatccagacagacatatttttcattcattctgcaatgaccgcattttccgattccacaacacatttttctctcataagaagtccagatctgctcatctttaattccaagtttcttaatttccataatcgtaaatttaatcatgaccggcggtcctacgcagataaataccgcattttcaggatttttaaatctcaaatccggaatatatttggttaccattccaaccggaccttcgtatccttccgatgctgcatctacggtctgaattacatgaaatgtttttttccattcttcaaaatctttcttaaacagcacatcttccggacttttaaatccagcaattagtgttgtactgactgcctcctctggatgagctgaaaaatactgaatcaccccacgcattggagaaactccggttccgcctccaataattacgagttccttccccttataattttccagttcaaacccattgccataaggtcctctgataaacaatttatctcccacataattttcaaatacctcgtttgtcacagttcctactcttcggatggtaaaatcgaccagaccatctccaattccactaacagaaatcggagcttctccatacttcggaatggaaagttcaaaaaactgtcccggttttacttctccatcatactccattcgaaaagtatattccaaatccgtatgttttatcacttcttttattttggaaagcttaggaatgtattcattcttcatttcttttttcctccttgctcaaccggttaatcagatttgaataggaaatatactctgggcagacactgtcacatcggccacagcctacgcacatcggatatccaaaccgcttctcataatgataaattttatgtaaaactttaaaacgtaccttatctgctttttttgtacggaactcatgcccgcccgcaatcgtatcgtatttatctacctgacaggatgcccacactcttcggcgttctcctgccttttcattatctttataaaaaatatcctgcattgtaaaacaagtacatgtcggacagacaaaattacaacgtccgcatccgatgcaacgtgctccatactcttcccagattggaagcttggcactttcttttgataaatgttttggaagttctaccttttctaaatttgcttgtacaaattccggtaacacctctgcttccggcatacctttgaaatatttctttaactcttcatctgaaacatcaagacagacacggttgtttttcaattttaaataggcatcatagttctcgcttttgttggttcccatgctgacacaaaaccctgtttcacaactttccttacatcccatcaagataaattttgcttttttacgcattctcgcataatagaaatcttcttttccactctttaaatacatttcatccaatcgttttaatgcgtgcatttcacaggaacgaagaaaaatgagcaaatctttttcctgctctttcggtacgattgtctcatcttctgtaaaataaaaaatcgtctctctgattttaagcagcgattccttaaaagaataatctgaacgcttttcccattcaatttcatccaaatcttttatcttatcatatcgaatcacatcgatttctgagaaggttccctctccttcttttcgtaccggagcccagatatcatatttcttttttatggactcaaatatttctgaaaatgcttctctagctaactgatatcccataatcgttcctttcttcttactatttctatttttttatacaaaaaaatctttgttaatatcattttatcaacaaagattttttctttccgtgataatcatcacgttttattattctttttcatgaatttttttcaacaacttatcaatatctggaacgagaatcagcttttcttgatattcaattaagtttgattttttcaaatgtcccatcactcttgagacggattctctttttgcccctagcatgtctgccagaaatgtaatcgttactttaaatggaatctgtattcccgatggagtctctatcccatagtctcgagccaatttccagacctttgctataatctgcttttcaagcctaaatgaatttgaagtgttcgccagctgatgatacattttacgaattttctttgtgcttgaatagaccacttctcttgaaaatgctgcatcttccatatagtccataaaatattttcttggaatctttaacataagggtatcgcaaagtggctctgcactgattgacgcgattggtttttctacaattacttcatttaaaagtgcaccatctgtataaataaagatatttttccggtctccacggtgattatgacggtacagcaccacatagccttccacaatgaagtataatgtatctactcgttctcgctcccgaaaaataggaacacctttttcctgaagcactatttgtccgttcttttgcactgattcttttattgtttcactcgcattgttaagtatcgtacacttttggattgcttcactgatttccatttttctaccttacccctgataccctgcaagaaactgtgcaatcaactcaatgcacccttccacatctttttcatctgccacttccgccggcatatgcatatagcgcagcggaatcgacactaacaccatcggaacaccctgattagaaaaatgaatttgatctccatcggtgtaggaaagtctgcttgccgcttctctttgcacagaaatgcctgctttctttgcacactcttccatcttttcattgagtgcttttaccacaatcggactgttacaaagcaccggtccttctccaaggcataccgttcccatctctgccggatccattccactgcaatcacttgtatatgtaacatctactacaattgccatggtcggctgaattctggcactggtccaatatgctccggtcttggttgtctcttctcctgtcgtggaagctgcataaattccaactttacatcccaactcttttgatcgtttctttttcaaaggagaatattatgcagaaaaaagtaactttgttaacactcatcatcgagttaggcaaactactcttaagtattggattgctcgtaagcactgtagttggattatatctaatgttttttaagttttagaaaaaatacaacaaaaaagtccttgcttccaaggacttttttcactgccgctggccggactcgaaccggcacggtgttacccgcttgattttgagtcaagtgcgtctgccaattccgccacagcggcaagctgatttgtttggctgaatcgtatattataatatcatgctttgctacacaatgcaagcttttttttaatttttacgggcagattttttattttctctgcccgccttgtcttttttactgctgaatcagcttatcatagatatcaaaacagtcaaatgttgcaaaatagtcttttggctcttctgctctgcggattaactgtgtgcttccatcttcttttaataagacttctgctgatttcaattttccgttgtaattatatcccattgcaaatccgtgtgcaccggtatcatgaattaccagtaagtctcccatatcaattttcggaagcatacggtctactgcaaatttatcattgttttcgcaaagagaacctgttacatcatatttgtggtcgcaaggttccttttcttttcccattactgtgatatgatggtaagcaccatacatagccggacgcattaagtttactgcgcacgcatctacaccgatatattctttatgagtatgtttttcatgaattgcttttgttacaagacaaccatacggtcccatcatgaaacgtcccatttcagaatagatttctacatcacccattccagccggaacaagtacttcttcataaactttacggacaccttctccaatgacacggatatcatttggtttctggtctggtgtataagggataccaacaccaccggataaattgataaatttaatatttgctcctgtttcttcttttaattttacagcaagttcaaacagacgttttgcaagttccggataatattcatttgttacagtgttacttgcaaggaaagcatgaataccaaattcttctgcacctttttcttttaaaatacgaaacgcatcaaaaatctgctcggttgtcattccatattttgcatctcctggattatccatgattccatttccaagttcaaatgttccgcctggattataacggcagctgattctctttggaattgttccgatagtatcttccaagaaatcaatatgagtaatatcatctaagttaatggttgcacctaatttataagcataagcatattcttctgccggtgtatcatttgatgaaaacataatatcttttcctgtgcatccgattgcagaagacatcataagttctgtataagaagaacagtcacagccacagccatactcttttaagatattaatcaaaaatggatttgggcaggcttttactgcaaaatattctttaaatcctttattccaggaaaacgcttcttttactgctttgatattttcacggattcctttttcatcatacagatgaaatggtgtcggatactgttttacaatttcatccaactgttctttagtaacaaatgtttttttctccattttgttctattctcctcaatttttctctctaatcacatatacacggttattatatgtcacatgctttcatttttcaacaaaaattttgcagattaaagtgataaacaaaatcattactgatttacgatcacccaggaaaatgcttttgcagttcttttctctgcatctttaaaatgatttccttgattccattccaaaatacacttcactttattttctttcataattttctccacttctctaatattatctccaactgttgacagcatcgcatttttggttttgtcttctttgtctccaagactcaaatagatacatggactttttacttcattttctttcagataagtaaggaatcctggaaaccatactgacggtgatgcagccgctatccctgcaaatttatcactctgacagcacgcccaaagactaaatagtcctgctaaagaatatccacccagataatattttttatttttatctgagcataattgcggtatctctgtaagcaaatttgatgctccatcaccaaatgcttcttttccaaatactgccggtgctttccatggtgataattcttgattccagttatctacctttattgcaagcatttgtatctctttttttgtatttatttttattcgttcaacttgatttggtatttcattcagattatgagttccaacaggttggattagtacaatatttgattctggatttccatatttatatagcttcattcaaacaatttctcctcacatctttcattcaaattcctgctttttatcattagaattctataactatacgccaccacttttcatttgctgaccgattttcactctaaaatttccactcctgctaccaccccattacatgatatctttcttttgatgcagtatacattactattcctcctatactctcaaattctttcgggttgtttttatactacttatgttgtaattctttttacaaacatcaattcatgcctttattatacattaaaattttctctactcatactacaaatatttatgctacaaaaggagctgtccatccggacagcccctcctatctgtttctatctctattctaatcgattcttattttacctcaattacatgaagcatattggtaacattctgttcatttacagaactgtttgttgccgggtcaccggcagttaagactactaactgaccttttttcaccagacgtttgcgttttactgtttccattgagttaagcaaaatattttctgttgagtcttttgtataaccttttaatggttttacaccccagtaaagctgcatcttatgctgtacagattcgtttggtgtaatcgcataaatcggcattggaggtctgaaactggataccagacgtgccgtcttacctgacattgtcggtgtaataatgcaggctgcctccagatttcttgctgtacgcacagaagagattccaattgcacttgaaatttttgtcttccgatacatacttctgtgtgtaacatatttatcataatctacatactgttcggtgctttctgcaacttctgccatcatctttaaggcttctaccggatattttcctgctgcggtttctccggaaagcataacagcgtctgttccgtcataaattgcatttgctacatcgccaacttctgcacgggttggacgtggattacgaatcatggaatccagcatctgagtcgcagtaataaccggtacatatttttcattacatttctgaatgattgttttctgaatatgtggaacttcctgtggcggaatttctacaccaaggtcgcctcgtgctaccataattccatcagccgctttgatgatttcatcaatattatcaacaccttcacggttctcaatttttgcaatgattgcaatatgctctgcatgatgttcagttaaaatcttacgaatttcattgacacctgctgcatttctgataaaagaagcggcaataaaatcaatatcctgagaaattccaaagataatatcatttttatctttttctgtaattgccggaagtttaatttttacattcggcacattgattccttttttctctccaagttctccgccattttcaatcagacagacaatcgaatctttctttgttgcctgtacttcgagttcaatcagaccatcatcaatcagaatcttgtcacctttttttacatctttcgcaagaccaggataggtaatagaacatcctttttcatttcccacgcactcttctatataaagagtaaaggtttctccctcttttaatgtaactttctgtccgccttctaaaactccggttctgatttccggacctttcgtatcaagaagaattgcaaccggtcggtctaattcctctcttacgtttttcagcagattcatacgatttttctgttcctcatagtcaccatgcgaaaagttaaatcttgccacatccattccattttttacgagtgcacgcattatcgtttttttatcggtatttggtcccatcgtacatacaatctttgtcctgcgcataatatcatatcctcctgattatttgatatgtgtatgtgtaaataaatgttcctgacaatattcatagtttccattgcatttggaacagaaacgaaattccaaatcgtccccgtcattttctgttctgccacaaattgcacatttatgttttgttatatttggtgtcatctttggatgaaccgccttcttaaactgctgttttctgtgtatttcacgtggcgaaatcgttttataatttcttgtcataaagaagaaaataataaaattcagtaacgacacaagaatcatcatacggacagcccatgcaccatatccggatacacgaataaagttataagccagatatgcaatatcaagatatgccatccatttaatcttaatcggtattacaaaatataacagtacctgcatatccggataatttgccgcaaatgcaaggaatattgacaagttaatataatatgtcgaaattatgcttgctccataaagggaaatctgaagtccgccaatgaaatacagcaagaaagctccaatcacagtgaataaaattccactgaaaatgtacacgttataacggaactctccccatgttctttcaagcgctgttcccagtgaataataaaagatcagcataataattgtaaaaatatccagtcctgaaggcggaattaacacccagctcaccagtctccaaatttgtccatgcagtatatggtacggactcaaagccagatagcccataatacctactccggtcatgttttgaaaaacctccagggcatatccaatcacataacacaaaataatatatttcgtcaattccggtattgcatacctgccgaatttccgttccattttatttaaaaaattcatttcatttcctcatttccggtttattcccgccctcaagaaattttctgatttcactttaaattaaaggaatgaaccctaaaacaggtctttctttgaaaaaataattgccacaatcagacttagtatcaaagacaacacaattacaatagcaaatccatacggactgtctgcaaatggcatcccgaatgattttacattcattccataggcactgaaaatcatagtcggaatggacattacaattgtaactgttgccaaaaatttcatgacaatatttaagttgtttgaaataacagacgcaaacgcatcggtcattccacttaaaattccactgtaaatatttgccatctcaatcgcctgcttgttctcgacaataacatcctcaagcaggtctgtatcgtcgggatattttttaatccggtctacctttaaaagcttttccagcaccacttcgttagaacgaagggaagtaataaagtagaccagtgatttttccagttcaagaagttctatcagctcctgatttctggtcgaagcatgcagtttctcttccacttcttcacttttcttatctatgatacgcagataatgcaggaacatgcttgcattattatacagaatctgtaaaataaaccgcgttttcatataagtataaaaattgcgtacacgcccgtccatgaattttccaagaaccgatgtatcttccagacaaactgtaaaaatcatttcatttgtgattataatagaaagaggaatggttccaaaccagtccttgtctcctctttcctctataatcggagtatccaccaaaatcaaggtataattttcttcaacttctatacgggagcgttcttcttcatccagaggtgcacgtaaatcatctacttctatctgaaaccgattacagatttcaaaaatttccgtagcagtcggatttgtcagggcaacccagcaaccttcacatgcttcctccatctgatgcatttttccatcaatggttttaaaaattcgaatcatggtatctcccttcgtctgccatgaatattattctgcgtaatcacatttatggaaaataatactgtttggagtttctaccttaagcggttttcctttcataatcaacagctttttctcataatcaattgaaaatgttgtgatagagtttgattcatgattgacaacagccagatgacgaccgtccgggaatacatcaaggtcttttggatattctccactgattggcagtacgaactgtctttcaatatgacctgtctcttcatctactttatacattgcaaccgtattttctccggctgtagaagtaaacagatattttccatcttcagaaagacacattccagaagttgcatcatgtgcctcatcttcatgggaagccaaagtgctttctgtctgaagcagttcaaatttcggatttttaccgcttccatcataactgtaaacctgaatttcattttttaattcatagtttacaaaggcaaactttccattcgggctgaatttaatcagtctcggaccagattctctgacacaacgaagaacgtcaaccaaatccagcttactggttctctctgtcggacgataaatcttaatctgatcaattccattatcaactgcacacagatattttccatccggagtcggacgcacacaactgacatgaggacggaagtttctttctgcaacactgccaagacctttatggaagacaccatccataacacttccaagtcgtccgtctctatgtgtgtgtactacggtaacttttccatcatggtagcctgcaacatacagatattttccttttgtatcggtggaaaggtgacagcctctcattccatcaataccaactttattaataaaggttaaatccccatccggctcgattgcaaatactgccacaccttcatcagcgatagagtacagatattttccgtttacagagatagccagatgggaagaattatttacaggaactacttttctctctgtcatagttccctcttccacatttacgtcatataaatgaattccaatactgcttccgtgagtataagttccaacataagcaacatacttttctttcattatagtaataccctcctgtctgttttttattcgttccgttgtccggtctaccgacattctaccacaaagtttttttttatacaatgcaatttcccccgattttacaaacatttatctcgcccttctattgacaggattttcggttctagtataatgaaatttaaaagcctggtaggaatcattccgtttctgccggcattttatttactatactttatttaaggagactgccatgaaaaaaacactggtggattttatccatatctcaaaaggatttggggaacagcttgttttagatgatttaaatctgtcggttcatgaaaatgaatttctcactctgcttggtccaagtggatgcggaaaaacaaccactcttcgtatcttaggaggatttgaatccccggacaagggacaggtcatttttgacggtcaggacattacgcatcttcccccaaataagcggaatttgaacaccgtattccagaaatacgctcttttttctcacatgagtgtatccgaaaatattgcttttggcttaaaaatttccggaaaatctgatgcctatattaaagataaaatccgatatgccctgaaacttgtaaatctggaaggatatgaaaacagacttccggattcattaagcggcggtcagcagcagagaattgcaattgcccgcgcaatcgtaaatgaaccacgtttactgctcttagatgaaccacttggtgctcttgacttaaaacttcgtcaggacatgcagtatgaactgattcgtttaaaaaatgaacttggtattaccttcatctacgtcactcacgatcaggaagaagccctcaccatgtccgatacgattgttgttatgaatcaaggttatattcaacagatgggttctccggaagatatctacaatgagccacaaaatgcttttgtagcagactttatcggagaaagtaatatcatcgaaggagttatgatacaagaccgcctggtacagattcttggtgcaaaatttgattgtgtcgataccggatttggacagaataaaccggtcgatgtagtcatccgtccagaggatgttgaccttgtagaaccggaaaaaggcacaattaccggtgtagtcacacatttaatttttaaaggtgtccactacgagatggaagtgcaggcaaatggatttgaatggcttgttcacagcacagatatgtttccggtcggacaaaaagtcggcattcatgtagacccgttcgatatccagattatgaataaaccggaatcggaagatgaggaggcgataggagttaatgaataagaaaaaattgcttgccggaccttatcttttctgggctctggcatttattctcatcccgcttgctatgattgtctactatggtcttactgatgcaaatggtcatctgacctttgaaaatcttctggctatcggaacggttgagaattttaaggcactctgtctttccctcctgctttctctcatcagcaccgccatctgtctgctccttgcctatcctctggcaatcattctttccaatatgaaagttggtcaaaatggatttattgtgctcatttttattatccctatgtggatgaattttcttctgcgcacactggcatggcagaccctgttggagaaaaacggagtcatcaatcaggtgttacactttttccatctgcccacactccagctaatcaatacgccttatgcgattgttctgggcatggtttacaactttttaccgtttatggttcttccgctttacaacgttctctccaaaattgacaaagatgtcatttctgccgcaagagacttaggggcaacagagctttatacgttccgtaaaattatctttcctttaagtattcccggtgttgtaagcggtattattatggtttttgttcctgcacttaccacctttgttatttctgatttacttggtggaagcaaaattttgttaatcggaaacgtcatcgaacaaaaattcaaacaaggaagcaactggaatgtcggaagtggtctttctctggtgctgatggtctttattttgatcagtatggtgattacaaccaaatatgataaaaatggagaaggaggcatgttctaatgaaaaaaacagcacgtaatatctaccttggattcattttatttttaatgtatgccccgattgcgactttggttgtactctcttttaactcatccaaatcccgttcaaaatggggtggatttacgctcaaatggtattcttccctgtttcaggacgacgccattatgagtgccctttataatacccttgcaattgcgtttctttctgccttaattgcaaccattatcggcacttgtgcctctcttggcatcaccgcaatgaaagcaaaatggcgcaccgttatcatgggaattaccaatattccggttttaaattccgatatcgtaaccggaatttccttaatgctgctttttattgcgtttcgttttactttaggcttttctacaatcctgattgcacacattacttttaatattccttatgcaatcttaagcgtcatgcccaaactaaaacagaccaataaaagcacttacgaagctgcccgcgacttaggtgcgggaccatttcagtcatttatgaaagtcgtatttccagatatcctcccgggtgtattgtccggatttttaatgacttttaccatgtcactcgatgattttatcatcacccactttacaaaaggtcccggagttgatacactttctacaaagatttattctgaagtacgaaaaggaatccgtccggaaatgtatgcactttccactcttttattcttatcggttatggtaattatgattttaatgaacacctcaccaaaagaaacagattctaaaaaggctggttcaacctcaaaagattttaaacgaaagcgaaaaattccatggcatcaggtaatccctgccggatttatcttattaatcgcagtaaccggattagttcatcatgtaagaacaaccggaagtgtctccgaagaacaggtaattgtttacaactggggagaatacatcgaccctgatgtgcttgacatctttgaagaagaaaccggaattcaggttatctatgaagaatacgaaaccaatgaaatcatgtatcctaaaattctttccggtgctattgcttatgatgtagtatgtccttcggattatatgattcaacgtatgcgtgaaaatggactgttaagcaaattaaaccttgataacattccaaatctgaaaaatattgaccctgcctatttaacccagagccaaagttttgaccctgataatgaatattccgttccatattgcgttggaacaatcggtattctctacaataaaaatatggtagatgagccagttgacagctggaatattttatgggatgaaaaatacaaggatcgcatcttaatgcaggattctgtacgtgatgcgtttgctgttgccttaaaacgtaaaggctattccttaaactcagtcgaagttgatgaactcattcaggcaaaagatgatttaattgcccagaaaccacttgtacaagcttatgtagtagaccaggttcgcgacaaaatgattggaaatgaagccgctctcggggttatttattccggtgaagcgctttatacacaaagagaaaacccagcacttgagtatgtcattccaaaagagggttccaatatatggattgactcctgggtgattccgtccaacgccaaaaataaagaaaatgctgaaaaatttattaatttcttatgccgacctgatatagctcttatgaactttgagtatatcacttatgcaactcctaatgcggctgcaagggctttaatcgaagatgaaagtatccgaaacagtgaaactctgttcccatccgataaagatttggcacgctgtgaaacattccgttttcttggagacgaggcagattcttattacaacgaactttggaataaagtaaaatcaaattaggagtgataccttgaaccgaacctttacttatcttattactcaaaaggattccccttgcacagtggaatcctatttaaaaaaacgaggttattctcatccgattttggttcagttaaaaaagacccaaaacggaattttagtcaatcaaaaatgggcttatgtcaaaacaattctaaatcccgatgataaacttgaaattcatctggaagagaccgcttcttctgaacatattgttccggttgagcttcccttctctattgtttatgaagatgaagatatccttgttgtaaataagccggcagatatgccgattcatccctcaattaataattatgaaaatactctggcaaatgcagttgcctactattataaaaaacagggagaaacttttattttccgctgtatcaaccgcttagaccgtgatacaaccggacttttaatcattgcaaagcacgctttaagtgcctcgattctttcaaaacagatgaaggcacgtgaaatccgccggacttatcttgcagtctgcaaaggtcagcttccggccgaagtcggcattatcaatgccccaattgccagaaaagcagattctgcgattgaacgctgtgttgatttttctaatggagaaagcgcagtaacccattatcgggtgcggtattaccagaatggctattcccttgtggaacttcatttagagactggacgcacccatcaaatccggattcatatgcagtatcttggaaatccacttccgggggattatctttactgtccggattactctaaaatctcacgcactgccttacattcctaccggcttgcattttgtcatccgattaccggaaagcgaatggatttttacgcaccgcttcccacggatatggcagcattttttcagtaaataaaaaagtactgcgtatttctttcaaatcacgaaatacacggtacttttttattgctctttattattttttctggctgctcatacagataagcctatgggggttctccaccaatttataatgcccgaattctcggcacttcatctacatgcagatattttccaattgtttttacaataatatcatggttgataaatggattctgatctgtcacgacaattgctccaatgactcccacttcctctacacgaatcggaaatcctccacccatgcaggaaaactctttttcatcaagtccaatatcttctaaggtttcttcattttgctttaattcgctgtataaaagcagactgcttttttccattatttttacggtattgaaggtccggtctgtaaaacggtcactgtttaatgtagtcgtatttccggcatacttaaataccgtgctgccattattctttcgaattgtaatcgaacaatccaatccacgttttttactctctgccaccagcataattcctaactgccatgcatcctcatttgtaaaatgattgaactgtaaaatctcttcctgcagacttaaaacattaattacttcatccattgtcatacgccattcctcctgtctgactttatgtgaaatactttttatatttaacggattctgtctggaaaacctacttttcgctgtactttgcggagtgttttatttgcataataactggctttttctccattttctttgataatagaatctaagtaagctttatctttttccagtctggcaacttcatcctgaagtggttttaacacacttactacagcttcaccgactgccattttcagttctccataacctcttccttcaaattctttcaccgcttcatccggtgtttttccgacacatgcgcagtagatatcaatcaggtttttcagtcccggctgctcctctctataagcaatatttgcctcggagtctgtcactgcacgtttacatttacggataattgtatccggatcatccatcagataaatacttccatttggattttcatcggatttagacatctttttagacggatcctgaagactcatgatttttgctccaacttttccaacataagcttccggaatagtaaatacatccccataaatattattaaaacgagtagcaatatctctggttaattccaaatgctgcatctggtcaattcctaccggaacaacatctgcctgatataacaaaatatcagcagccatcaagaccggataggtaaataaacctgcattgatgttatctgcatgttttgctgatttatctttaaactgcgtcatacgattgagctcgcccatataggtaaaacagttcaaaatccatgccagttctgcatgcccggatacatgggactgataatagatacaattctttttcgggtctaaccctgctgcaatgtaaagagtcagaagtgctcttgctctttttctaagtgtagctgggtcctgacgcaccgtaatagagtgcatatctacaacactgtagaaacattcatactcgtcacttaactttacccagttttttaatgccccaagataatttccaagagtcagatttccagttgcctgcataccactaaacaacacttttttatcattaatcatctttttgtcctccaagttttgctaaaataaattgtaacattgtgccactgtaaagtcaaatatacttgcacgaaaatttaattcgatttataataaattttgaaaaaacaaaccctgaaaggagaattagctacatggaaaaaattgcaagctttaccattgaccatataaaattacagcctggagtttatgtttccagaaaagatcacattggagacgaagtaattaccacttttgatttaagaatgacttccccaaacgaagaacctgttatgaatactgctgagatgcacacaattgaacatctcgctgctacttttcttcgcaaccataaagagtatggcacaaaaaccgtttactttggacctatgggatgccgtaccggattttatctgcttttagcaggtgactacgaatcccgcgatattgttgatttaatggtggaaatgtttactttcatccgtgactttaagggcgaagtgcctggggcttccgcaaaagactgtggaaactatcttgatatgaatctcggtatggcaaactatcttgctaaaaaatatctggatgaagtcttaatcgatatcaaaccggaacgtctggtttatccagaataattccaagttcaaatcagacaatataaaaatataaaaacaccaaaaagaggaagcaaagtttacttttctgcttcctcttccggtttataatcataatcttttaattctgttttctcttctgcttcacaaagatacacatcttccagatgacgttttaatacccgttttcctccggtatctccctctaattccagcaattcttctcggtatttctcatgaaaaattaccggatttccaatttgcccgttccatactactgctccgattcctttttcacttctttgaaagccttccaacagacgaagaatggtctcttgttttaaatgtggctggtctgccacaacaaagcagtaacattctccttttacattttctttatgaaccgcccgaattcctttttttatcgaggcagaaattccatgactgctgtctggattatccactgccaaaaatccatactcttctgctgattttcgaattcgttcatactgggataccacacacactcctgccacatgttctgaatgttgtctcacccagtccaacttttccattagaatttgatacattggtgttttttccatcgaataaatcagcttatttccaccaaatcgtcttgaaaaaccggatgccagcataatcagaaaaaacttctttttttccggcatttccaattttttctcataaatcaccggaacagacagcttttcttcaaatgtttgtgaatcctgctgattaaaaatcactccaatttttctttttgaatttgataaagaaccggttaatttttcaagataccctttttctaacagctttgccacaatttccggcgtcaacagtttttctctacaatccgcctgatttaaaatttcctgtgctttttccagtcggaaacagacttctgataatgggtgattaaatgcctgcatgctctctacaattaaaatatgagttgttatctgataaatcaccggctcatgttctgccggcactttaaagggataatgtttcgctccatctgcttcaataactactgcatcataactttctaacacttcttctaactgtgtttccaaaagccccgcaattttcttttcctgctccagttttcgccctgcaattacaacttttccgggtactcctgcctcttttatggtcttcgtatctgcatcaagaagacctgtccttccaagataaaatggatgctgaatatgcgtacttgttgttaccaatactttcattcccagacctgccagctcatctgccagctttaatacacaagtggtttttcctcctgctcccacaaaagaaaacactggtttttctggcagttcacccattgttttttttatttttttcaacagactcatagacagcctttctcataggcacagactaattctaatacgcttcctgccagacatctcgccttatctgaaatcagggcgcaatgtttctgcgattcttttcttgggtcaacatctgcactcttaaacccttttgtcactggaaaaccatctggtaaaattccacgaatcacacccgtaatttctgtttttacttctattacttctcctgtatctgtttgaacttctccaatacaggctttcgcttctacccagtctccaatatcaaactttttaaaaaacacaccctctgccggtgcatgaatgactcgctcttttccgtatccgccaatgactccgggaatccccgtattttcaattgcacttcctttgtctaaaattttcccaaggtaatgccctcttttggtttccactacataatccacatcttttcctgcttcaaatcctggaccaagtgcaatcgtaagaggtgccatttttcttgttgttccaagattttttttcgcaataattgcatcaattaaaatttccggttttaatagaggaatactttctcctttcgggtcaaccaaaagcaccggatgcagtggttttgcctctttaagtgcctcttttacactattcacgcaaacgcaggttatcccttctacacatgcactgccattttctacagcttccgaaaatgcaaccagacgccggatagctgacggcttatctgtctctaaaacaatcacagaatatccgctttttgaaagacggtgaatcactcctgttgccaaatctccgccgcctcttactacgattggcttcattatcctatcctcctgttttttcatttctttaaggacggatgaccttcgtagctcccgccattttctgtgcaatttcatacatatttgtcacatttccaactacaagcttggactgcatttgataatgatttaagcaagttccacaggctaagatttccacaccatttttttctaatgtttttaaatcttccagactttctgaaccttcacatgcgaggaaaattccgctgttatacattaaaactgtctttggaagctcctctaactgggttaaggcatagatatatcctttgattaaaatttttccaagtacttcatcgccctctcccatcttatttgagcacagtaccaccactgttcccttccctgccggttttacttcctgtggctgttcttcttccgtttttgctgacgagagttctgtcttatcagtcgggacaatatgtacctcatatttcttttcctctaatctggtataggcaaattcacaattttgagaagacgcaaactttctcagattatctacagcaatctgattgtcaaccagaatctgaaatccttctttctttccttcttctaattctttttttgctgccacaaccggtcctgggcatgcaactccaagtgcatcaattactttcatctctaatccctcctaaatattctatttaaagcattacatggtaaatttggtcaaattctatcttcttatttttcattttcgtttctaagactttttctttttccggtaaagtacaccaacataatccacagcctgccgatactacacccggcagaggaatcagacgtcccggaagttcttctttttgacagaattcctccattgcaattgcctgcgtagttgtatgaaaggtaatcaccagcttcatcgtcttttttctcatgttttcatccccttacgcctttcatctttattctaatagaaagcaacaaaaaaaacaagaatagaaaccttctatccttgttttttgtcctacacattatcttgctttttttaatgcagcacgaagcgctgttcccacaatcattgctactacaattttaactaaatctcctggaatatacggaatcactcctgccgcaagaccagctgctgcactcatatgtgcctggaagcacaaccatgctgttccaaatgcatagcagactactgttcctaataccagtccgactgcttccattactttattccccggaaacagtttcatcaaaagccctgcaattaaggtcaggaaaataaatccaatcaaatatccgccagtcggacctgccagttttccaaatccaccggaaaatccagaaaataccggaacaccgaccattccgattaataagtaaaccagataactaattgttgctccattcagacccaacacataaagacttaaataaattgctaagttggtaaaactgattggaaccgggctaaatggaagcggaattgataatggacctaaaatacaggttaccgctgtcatcagtgcaataaatgtcatctgtctggttgacattttctttgttgtatgttctttgttcactgttgctgtattcatgtttttttcctctcttctctttgtttgacttccttagtatatagaattccgtctctaatgtcaaccttttttatttattattagttaacatttattttaacaagaaaacatggataacaattccatgctttctttccagattacttttttcttcttaggtcaattttttgttttcatttccgaagattaagataatccaaaattaactctaccgtttggtcgattccaagcacccctgtatcaatgcacaagtcataatgctctgcttttccccaggtttctccggtataatacttatggaaatccgccctctcctgctcgattttttcaattcttgcctttgcttttgccggactgactccatctcttttggtcaccatgttcactttatccgatttttgtgcatacagaaaaatactcgtacagtctgcatcgtctttgaacacataatttccgcatcttccaaccaaaacacaggattgattttcacatagcttacgaatcctgtcaaaggcacgttttcctctgcatccttcttcctgattcatcgcaatcgcataaagcaggctgttaattggctgttcttcataaaaacagcttacttcttcatatcctgatttttcctttgcaagtttcatcaattcttcttttccataaaacggtattgcaagacgtttcgcaagttttttcccaatttcttttccaccgcttccatactgtctgccaatggtaataattaatctactcatgccttacacactccttttctacataaacccagcaaatacacttgctcctactactgtaagaagtcctgctactgcaattgcaagactgctcatcgctccttcaaccggtcccatttccatagctcttgctgttccgattgcatgagaagctgcgccaagtgccaatccttttgcaaccggctcttcaatgtggaacaccttacagaccgtctcaccgatcatatttccaaggattcctgtaacaatgataacagctacggtaatcgttacaattccaccaagttcttctgatatccccattccaattgctgttgtaatggattttggaagcatggttacatactgttcatgagaaagtccaaataattttgcaagtattaatactccaacaagacttgcaagtacccctgaaatcaatcctgcggcaactgcctttaagttcttctttaataactctaactgctcgtacaacggcactgcaaggcagacagtagccggtgttaaaagataactgatgtattttccactctgattataagattcataactgatatttccaactaccagtactgcaataacacaaattacaccgattaagagcggattaaacactgccatcttaaattttttctttaaaatcaatccgatttcataacctacaagacttaagactgctcctccaaataaagaaacatctaaaaattctttcatttcctcttcccctttctgataattccctgtgtcacaagtccggttaccaccataacaaatactgttgtcacaacagtaataattccaagcggaataatcaccggctgtaagattccccaggaatcaatcagacctgctgctgccggaatgaacataaccggcataatctctatcaaaaaagcagatgcctcctttacctgatgcagttttaatactcctgtcataagtgctgccagcataaacaccagtccatatacacttgccggaatcggaagcggtaacacctgatgaagcacttctcctaaaaaggaaaaggctaaaatgaccataaattgctttaagtacttcataatctttttttcctgttctcctctctttttgtgtttaccaatttaattttcgtctttaccaattatactcttgcgccaaaaaaagtcaatgcaggaatgtaaaacattcttaaaatctctgcattgacctcttgttttaaagttctaaaaatccttttataattacacagctttttactggcgaatataaattccctgttcttcaatgaaatcttccaaatcctgaagagcatcctgcgcccaggtttctgataaagataagtctgccggttttgggaaaaacatcgtttctgccatttcttttccggtttttgtcttaaaaattttctctactgatttttgaatagtatcagcagaatttccgttttcaaaataattgaccagaaaatccgcttctaccaaaatctgataatccatcccatctatatttgtatacgtatgatgatgtcccaccagatacgaaaccctttcaatcacagcctcctcaaacccaatcacacgcatcatcttctctgcctcagccggtccttcctgctcctgaaattttccatcgctctttccatattttgcttctgccggcttgattccaatgtcatgcactaaagctgcgcactctaaaataaactggatttcttcctctaatttttctgcttttcctatcgcctgtgcaaagctgtgtacttttacaaaatgctggattcttgccgggtctcctgcatcataagccatcatttcccgatacagtgtttcttttaatttttcttttgcgtcttgattcatacgccatccaacctttcccttattatcgtaaagaaaatcaaaaaaagcagacaaaaaccttcaaaaagacttctttgtctgctttatttttccattatatcactcttttttgtatgtgtctattgcttttgtttccttaaaattactgtgtcaaaccctgcaattgtcccatcataactgcccagccatacctcaaatccatctttcggaaattctatttctatccggttacaattgaaattttgcacaatccgataaactgctttttcattttcccggctggtgacttccacaccataagggatttctttcattagaacagtaatgttgctgtttttcacaagctttttataaaaatcatcataaaaatcctgttcaaaatctgcacagatttcgtaacattcgcctgcaaaaattcctgtcaagcgaatatctgcaatatgctttgattaaatccccttaaaggaaaatttaaattcttttttctgacttacatccagcagatattccggatgcgttttggcaccccagctgtcatctccgccaacacccatctgctgcatagaagctcttactactgtataatgtactttcggcagttcaaacggatgtgccgcattttcaatttcatgcggagtataaggaagtgcggaaaattccattttatcactcttaaagagcatacctctgccctttctatccgttacttttgcccagcgtacccctgttttatttccacattcctgcggaactaaatattttgccatattttcttctactttattttgataaataccaagttttgcacctttatttctgtctacataagtctcttccggtcccattccataccaggttacctgattatagtctgcatcgaatttgaaaatcacaccaaattctggcatatctcctaagtcttttaccggttcataagaaagtaccgtctcgattgttccatctgcaaatacttcataagaaagttcacattctgcctgtggagtcgtcggcaggcaataagtaaaacttacaattgcagaatgtgcttttacttccagctttggttcatacattccaccctctggttttttatgcgataaatacaggcttgccagtttccactgtccataacgcattggcatcagatttccatagtcattatcggttggcgctctccagaaatttggttttgggatggcttttatcatttcttttccaccatacacataggataccaatccgccatttaagtatgagaacatcactttaaaaccgtccccatggatcccaatattatgtgtactcttaacaacctctaattctccctttggaatctgtgcggctctctcaaccttatacaccccctgtccaaaggcaacttcatgaccacgttttgcccagactgtatcctcttttaacagaaatgctactgttattacatactctcctgacagagtctgaacttcaaacggaagcggatatgtttttttactaagtggtgctacatctgtctcaagttgttttcttgcaagttcttttccatctttttcaagcactgccacacagtcaaactgatttgtattcacaaataaatttttattttcaactgtaacctgtgttttttctacgacagcagtaatattctggtaattgaactttacttcctgcatctttggagatggctctctgtctcctccataagcaattccatttccactaaaattataatcacacggacggtcatcaaagtctccgccatacgcctgaaactcttttccgtaacggtcttttttataaatagactggtcaatataatcccagataaatccaccctgatataacggctctgtatctgttaaatccgtatatttatgcattgcaccacaggaatttcccatcgcatgtgtatactcacagcagataaatggcttgcttctatcctttttcagaaattccttgatactttccacagacggatacatctgactttccatgtcactggtatcattatatcttctgtcattaaatacaccttcataatgtaccagacgggtcgggtcttccttacggtaaaactctgacatttcataaatcacacttccgccaaaggactcatttccacaagaccagataagaattgccggatggtttttatctctttgatacatggaattgacacggtctaacagcatgcctttccattcttctttatcacacggaacaacattggtataatccggatgctcttttcccgcctgagtgtcccagcttccatgtgtttccatattattttcagcaatcatataaattccgtattcatcacataactcataaatatcagaaccatccggataatggcaggtacgaattgcattgatattattctgtttcatcgtcaccagatctttgattaattcttcccttgaaacatgacgtcctgttacagaactaaattcatgacgattgactcctttaaagacaattcgtttgccatttaaggtcataatattgcctttcatctcaaatttgcggaatcccacgcggtatggaatcacttccataagcttctgattttcatcaaacacttgaatgagtaaatcatataattccggtgcttctgcactccataatttaggctgttctaccaaaactacaaacctgctttcactttcaagtgccccttctatatttacaattacttctccgtctttgctcagacaaatcttaacgtttccgtttccaactccttttaaaaccagttccaaatctgcttttgtaaaagtttcatccagtaaagtgcgcactctcatgtcacggacatgtacttctggaatcgtatacagatatacatccctgtaaattccggaaaaacggaagaaatcctgatcctcgcaccagctgctgcttgtaaatttaaatacctgtactgcaagcttgttttccccatctttaagagaatccgttaactcaaactctgacggtgtaaagctgtcttcgctatagcccacaaagactccatttaaccagactgcaatcccactttctgctccctggaaagaaataaaaactcgttttcctttcatattttccggtacttcaaaatattttatataacttgctaccggattaaaatgagttggaatttctcctagtttgacttcttcccagccttcccaagggtactgtacatttgcatactgaggctctccatatccctccatctgaatatgtgccggtacacggatatcatcccagtttttacaattatattctgttttttcaaatccttttatagtgctctcataattttttgcataatgaaatttccaaagaccatttaaatcatatttataattttcttctttttgcaacatcgcttccatggatgcataatatttatggtcggaatgtgcctctactctgttttcctggaaatactctggatcttttactttgccataatcaaaaccgctcatactatatcctcctaaaacctgatttttatcatactttctcagtatatcatatttcctttgacttcgttgattttctcaataaaatctcataatccatcatacttttttgagcgtatttttctccctgtgaactactcggcaactgagttaccagagcatctgaaatctggcgggataccgccttttttcagggtgcgtccatgacaccaatactgcttgcctttcggctatgcagctacttttattatatctggtttttttagtccggttacggacagttctttctgttttccggatacggaaagatatttccgcaggatattaaatgcgcctaccgcatctgcattgtatcttactccgtcagttacatacatgccccgttcttttcggtttgatgcttctgcatatctttttgatacttctggtgataacgggctgcactggctggtatagctttcttcttgttttatcaatgggatcccataccgtttcagcttatattccagcatgatatacaacttattatacggcaggctgtgaaacttctggtttgtcttgtgtcccatatctttttctttccggatatttcgaatgtctcccacaaccacacagcggatctcttcttttctgcagtattctgcgatccatctggtcactttgtgaagataatccttcactgcattctgctttttcctgtaaagtctctggatatgtttcgatgattttggatattttattcctctttccgattgttgtgtataccatactgactgcactctggcgatctctttatgaaaatatctttccaaagagagatattttcttcccaggataaaagcccggccatttccagaatcataacaggtcatcagattatgaatccccagatctatagataagtaatgtccattctgggaaagctgttccggctcttcactctcataaataacaataagggcgcattttccattctccggcggatagatccgcaattgttttatatggtccatgctcctgaaaatcttattttcaagatatagaaatttctcatggatctcgtatgtttcttccatatagcttttcagattctttggcagagacagtcgcagctggtctgaacctttctcatgctggatccccatctgcatatatgtaaccgggatatttccctgtttaaaacggggcggatttggttctttgatccctccagtcttttttaggacataaaaggatttccatgctttgtccagctgcttgcagatctcctgcgctgtctgtgacagaagctgtttataccacagatttcctttatgtgcttttttctgataataccagtcaggatacttttccagccccagctctttataatgacgccgttcgtagttgcagatattccagagtttggaggctacataacacatatgccctatgatattggaatattcctgactgatctttatggatgttttatgtgacagcagcattcctcttcctcctttaagcactgcgcagatagggcttcacactccatcttgaatcaatacgatttgctctgatgttcaatataacggcggatattttcttcagatacagatccgatcgtttccacataataagaatggttccacaaccctcctttccatagctggttttttatttccggaaaacgttcgaacagttttctgccagtgatccctttcaaatacttaacgattgccgttatagaaagttttggtggagctgatacaaagcagtggacatggtcgccttcaccacattcaaataaatgaacagtaaagcccttgtcctcagcaatctgctgcaccagttcctgaaggtattcctcaatttctggttttaatatcttccgtcggtatttcactgaccacaccatatggtagttaatattacacacgcaagttctataatgtattaggttttctttcatgcatatagtatatcatattgaattgtaatgcgcaacaattgtccgaacatattttcgtttttattatataccggttacggcatttattttttatatttatattttaacagaggatgaggattattatactgtttgcatcgtgcagatatgcacactcctgcgctttcatctcggtaattgaattgccgaggattcccgcttattgtcctaaacaatgaatcatctgtgttcccattcggattcccacctgtcttgccggaacactgaccgctgtaatcgacggtgaaaaacagtttaaattagaactgttatataacgaagcaattgcaatatcttttggcactcggtaacctcctgcctgtaatcgtgacatcatccatgtactgattacatcatcaccacatataatacactgtactttttttgcaatcatatcactgataattgtatccagaaaatcaattttcagagcaccggtataataaagctgttccctttcagggattccgttttttattaatgctttataaaatccattgcgtctgctgcgatttacgttaaaagataagtcttctaccacaagcgcaaaccgctcaaatccctgtcccactaaaattgagactaaatattgctttcatagatggaatatacatcctgaaaaagattccaaattcacttaatccatcaattcgtgctgcttcaataatgtccacaggaaaggctttcgcattggtacgagacatcataatcagaagcggagttgccagtgatggaagcataaatccaactgctgagtttaataacccaaatttggaatacatccgaaacagcagaaccttcctcttttttgcttgagccacaacctgccagcaggcttactgccattgttgagaccaaaatgcacgaaattaactttttcttcataataagctcctcctcttttgcgcaatttttatcgctctattttgcacaaaaaaaagaacccttattgcagggttctttttcgaacattaaaatcctaatttctttttaaattctttggtcagttttacacttccaatactttccacacttccagtcattttcagattccaattctcatcaatctgaatccacagctttccacccggcatgtgcaccatcacatcctgaccaacccaacctttcttatatgcaacagctgcggcggcacaactgcaggttccggacgccagaatataaccggctcctctttcaaagatttcaatattaagattatttttatcttctacttgaagcagcataacattaattccatttttaaacatcttagattctgcaatcttttttccaagtttacagaccttttcacggtcgattgtctctgccggaatcacacaatgcggatttccgattgaagcaataaatgcagaatatcgttcttccccaagcgttaccgttttttcctctccaaaactcattttccccatgtctgcctgaatccggcttccatcatcgtttaaaaaacgaacctttacgcttccacctgcagtctccagcgtcagcctctcacttaatgtataaccagcatcttttaaatatcttgcaaaaatccgaattccatttccagcccgctctgcttcacttccatctgaattaaagacacgcactctgatttttttctcttcatccagataaggtcctgctaaaattccatctgctccgactccaaaattccggtcacagattttttttatctgttctctggtcagtacttcttcattttttataacatcatacaccaaataatcatttccgataccctgatattttacaaattccattttattttcccccaattttctattcttctaatttcagaagtctatctattttctagtgtatcagacatctttatgttataatataagtattatgtcaaaaatgttgcaaaaaatgttcaatttatcagaagaaccgaaaggatttaacacttatggaatcagaaacattcaataaagccggatatttaaaagacaatttccgcttatttcatttaacagatacaaactctcttccgatttcctatcattaccatgatttttataaagtatttcttttattaagaggtgatgtcacttaccatatcgaaggaaaaacttatgacttaaaaccttatgatttggttttagtaaatgccggagaaattcataaaccggttattaacagcactttttatgaacgaatgattctatatatttccccggattttttagaacgttataaagaatccggggatttgctggattcctgttttaccaatgcagaaaataatcattctcacgtactccgtgtcgaactatttgccaaaagccgtctttatgaaacactggttgaactggaaggttctcttgcacaggatgactttgcttccggtctataccaaaacacactatttcttcaatttttgatattattaaatcgtgcttccatggattcttattcaagtgcctacattccaaacagctattgtaactccaagattctgccgattttagaatacattgcagaacatcttgtggaagatttaagtattgatacactctcttccaaattttatatgagccgttattacctcatgcatttatttaaaaaagaaaccggatacagcgttgccaattatatttccacaaagcgtctgctccatgcccgcgctttaattcaaagcggaacctctgtcacagaagcgtgctttgcaagtggatttaaaaattattctactttttcaagggcatataaaaagctctttctgatatctgcacgtgaacaccgctaatacagcataaatcaggcctctataccgacgctgtaccagttctgtgtcggtaactgtctgcacctttttcgtactttcatcatatagtaaagaaatgttttttctgactggaacaaacatgaataaaaaaacattcgattttaccatcatcggaggagatatgcgtcaggtctgccttgcaaaattactcgctttaaagggatactgcatctgccactatggtctctgcgaaccattaaaagcgccctgcatccagcctttggattctcttttagaagcagtctcctcttcttctgtttgtattgcaccaattccgttttccaaacttctcaataaaactccttatcttgaatttgctgacctgctttctgatggacacaccctgtttgccggctgtatcccaaagccttttttagaactcactcaaggaaaaaatatctctgcttttgactttatggcttcatctgaatttgcttactggaatgcaaaagcaaccgcagaatccactcttgcagctgccattctcttaagtccccgcacactttttgaaagccgttgtcttatcttaggatatggaaaatgcgccaaagctctcgcccgactcctttctatgcagacaccctatctaagtgttgctgcaagaaaccctgttcagcttgccgaagcttctttgacgggcgcacagaccatttccttagaacagcttttcgattgtgaattatcttcttttgattttatttttaataccatccctgcaccaatcttaacaagtgcccttttagaacagatttctccttctgccttattgcttgaccttgcatctgcccctggtggatttaacctcgaagaagcaaaagcaagggggcgaaatgcacatctgctcttaggactccctggaaaatacgcacctctttcctctgccgaaaaaatgatgtctttcatttttcagcacatcaaaatttcatcctaaataaaaaaggagaggttctttcttatgtcattatctggaaaaaaaataggcattgcctttaccggttctttttgcacctacgcccgaatttttgaagaacttgaagcactccaaaaagagggagctgtcatacagacgattttttctgactctgcacaaagtatcgacagccgttttggaacggctgaaagtttcttaaaaagagcagaagaaattacaggtatccctccaattcttaccatcaaagacgccgaaccaatcggtcccaaaagcctgcttgacctgcttgtcatctttccatgcaccggaaatacacttgcaaaacttgcaaacggaatcaccgatactccggttttaatggcagcaaaagctcatcttagaaatgataaaccactcttattatcagtctccacaaacgatgcccttggtttgaatatgaaaaatatcgggcttttaattaacgcaaaaaatattttctttattccatttggacaggacaatccagtcaaaaaaccaacttctctgatttcacatccagaacttctgattccatctattgaatcagccttgaacaaacaacagattcagcctttaatcaaagcctggtaatcaactcaccacttatagaattggaaaggagtatctctatgtgtggaattgccggattttgtaatccaagaaacgattttatgcaatctcaaaacaaatggatttctattcttgaagccatgaaccacacccttaaacgacgtggtccggatgatgagggaacgtatctttcctctcactgtggtctctctcatgtgcgacttgaaattattgacttattaaccgggcatcagcctatgataaaacaatgcgcctccggaaattattcgattgtctttaatggcgaaatttataacatgaaacctttgcgggaagaactgaaaaaagctggaactgtttttatcactaacagtgacaccgaagtaattttaaatggttttatgctttatcgggaagactttatcaaaaaattaaacggtatctttgcaattgcaatttatcatgcagaagaaaaacgactctggcttttccgcgaccgtatagggattaaaccgttattttttacgataacggataatacgcttgtttttgcatcagaaatcaaaggactctttatctatccgggaatcaatcctgtcgttgataaaaacggtctttgcgaaatctttgcccttggtcctgcacgtacttgtggaaacggtgtttttcaaaatatctttgaactgcttccaggtgaatttttaactttttccatagacggattaaacagacagttttattggaaattagaaagccgtccacacgaagattcttttttggaaaccatcgaaaaaacggcatggctgattgaagattctgtaaaaatgcagatgctttctgacattccaatctgtacttttttatccggcggcttggacagtagtctggttactgctatttgcgcaaaagaattgcaaaaacagaaccgccgattaaatacgttttcttttgactttaaagataatgcgaaatattttcagtccaactcttttcaaccaagtcaggatactccttgggcgaaaaaaacgagccaatatcttaataccgctcatcaccttttagaatgtgataacacagcccagtttgagtgtctgttccgtgctgtagatgctgccgacctgccatgtatggcggatgtggaatcttctctgttatatttttgttccaaagtaaccgcctataataaagtcacgttaaccggagaatgtgcggacgaaattttcggcggttatccatggtttcatcaggaaaaagcatttcgtactcctgctttcccgtggtcctctgattttgctcctcgaaaacttctcttgtccgctgatgttcttgccacacttccaatagaagaatactctgcctctgcttatgaagcaaccattgccgagactccacgccttttatcggattccccaacagaaaaacgcagacgagaaatttcttatctcaatctgcgctggtttatgatgacacttttaaatcgtatggaccgcaccagtatgtattccggcttagaagcgcgcgttccgcttgctgattaccgcattgtcgaatatgtttttaatgttccatggtccatgaaatgtcccaatggaatcgtgaaaggtctgcttcgatatgccggttctgaatttcttcccgaagaaattttgtggcggaaaaaaagcccttatccgaaaacttatgaccctgcttatgaaaccctcctcgctgaccgtctaaaagaagtgcttgcttctccaaatgcaccaatccgtaccttactggatacaaaaaaagttcatcaatttttagaaacaccatccgattataccagaccatggtatggtcagctcatggccggaccgcagatgcttgcttatcttttgcaggttaattactggctggagcactataagattaaactggtgtgaacaaaaacactttaccctatccgtattttcctaacaggactcttgttttacttcacagactgtcagacagtcgtcctttaccctgaagcggatttccattcctgcaaacgggaatccataaatccgctcggggtcttgttgataagccggtctgggatcttgttctaatactgcataaagcgccggtcttttttcttctggcacaagtctttctaactcttctggaatatcaacctttatcctgtcattttgatgcacacttgcaaaactaccttctgcttccggatgacaatccgaatacggaatataaggtttgatatcaaaaattggtgttccattcatcaaatctgcaccctttacataaagaatcggtctttctttttcatcaaattctatcttctctaaccgaacacaggataatcccattccatttggacgaaatggagagcgggttgaaaatactccttttctcgtatttccgcctaatttcggtggtctgaccgtcaaggaatagttttcccttctattttcggaaaatccccagataagccagatatgagaaaattcttcgagtccttttacagcttctttcgtgccatattccggttcaaataaaatctttccttccaattcttcgaccagaccgctctgtctgggaattccaaacttggaagaaaaatccgtaacaatgtgtgcaattgcctgaatttcatactgttctttcatcttatctcccctcctcgtccagctttccaaatgcaccattcggtatttccggataatgtttcaataattcttccactgccattctatactctttaagattttggcaacgtttgattttggtgttccagatgtccatctttggaaatgaataccgaagatagcaccagatttcctttaatttaaacaaggctttctcttcattgactgcattttcggtgaaatcctgataaagacgctccaaaaatgccccccaaacttcaagtgacggcaattcttgtccatgaattacggaaagcagacctggatttgcaagtacacctcttccgagcatcacgccatctattttcggaaatcgctttaccacgtcttcataatcctctttggtaaaaatatctccattatagattaacggtttttcattcttttgatatacacctgcaaacgcatcgaatcgtggactccctttataataatcagtctgaactctcggatgaacaattaattcctcataaggataattagaaaaaagttcaaatagttcatctatctcttcctcatgataacgaccaagccttgtcttaattgaaatttcgattggacatttatcaaaaatctcatctaaaaactgctttaatttttctttcttttctaaaaatcccgaacctcttccaccatttaccaccggtcttgacggacagcccagatttaaattcacttcttggtatccatattccattagtccttttacggttcttaaaaaatcttcgctctgattcgtcaatatctgtggaaccagatacaaattttgattattttccggaagaatatcccgtttttctctataattaaacaggcgccccttatttggctttgcagaaataaaaggtgcaaaatatttatccatcggtaagaaaaatgcatgataagcatttctgtaaattgcctctgtgacctcctctaacggagccatataatacttcattcttttagtttcctctcacttttctcttcaagtcgaacgcagacattatatcagagctgtccgaaaaagtatagtttctactcttctttttctattatttaaaattttttcaaaaaaatgcttgcttttttattacttctatgctattataaatctcggttgtaacactaataaaacttaaaaatctggctccatggtcaagcggttaagacaccgccctttcacggcggtaacaggggttcaaatccccttggagtcattaaggcgccatagccaagtggtaaggcaaaggtctgcaacacctctatcaccagttcaaatctggttggcgcctcttattcctccttagctcagtcggtagagcatgcggctgttaaccgcagtgtcgttggttcgagtccaacagggggagttttttattgcccagaaatgcgcatcgatgaaataagaattcatcgatgcgttttttatttgaaaaatccattctttaatcactttaagtcctaacgcacacagattgcatcttctcttacttccacaatctcagctacccatgctgcgtgtggaatcgtcagatattctgccatcgctggttctatagtatccccatcaatggtctgtctcccacagataatcaaatctgcgtcgccaatcacctggattccctgtgcaagcgcctaagaagttgccaagacatctgcccctgcaaattttcggtcagaaagaatcactgcgtcatctgccccatctcagctttaacttcttctatacttcttcataagtttgagttacaaaaaaagtcctaaaacaaaatgtttcaggactttttatttagaggcgccaaccagattcgaactggtgatagaggtgttgcagacctttgccttaccacttggctatggcgccttagtgactccaaggggatttgaacccctgttaccgccgtgaaagggcggtgtcttaaccgcttgaccatggagccaaatattcaattgttatcgtaccttcaaaactacatatacaaaaccgaaaccatgcagacacttgccgctccgctgatttctcagcttctggtcaagctctcgaccgattagtagcagtcagctccatacattgctgcacttccacctctgccctatctacctcgtcgtcttcaaggggtcttacttcctaagaatgggatatctcatcttgaggggggcttcacgcttagatgccttcagcgtttatcccttccaggcttggctactctgccatgcagttggcactacaacagatacaccagcggcctgtccatcccggtcctctcgtactaaggacagctcctctcaaatatcctacgcccacgccggatagggaccgaactgtctcacgacgttctgaacccagctcgcgtaccgctttaatgggcgaacagcccaacccttgggacctactacagccccaggatgcgatgagccgacatcgaggtgccaaaccactccgtcgatgtgaactcttgggagtgataagcctgttatccccagggtagcttttatccgttgagcgatggcattcccacttaataccaccggatcactaagccctactttcgtacctgctccacccgtcggtgtcgcagtcaagctcccttctgcctttgcactcttcgaatggtttccgtccattctgagggaacctttgggcgcctccgataccctttcggaggcgaccgccccagtcaaactccccgcctggcattgtcccaccgccgggtcacggcggctggttagaaacccaatactgcaagggtggtatcccaacatcgactccgtagcaactggcgtcactacctctcagtctcccacctatcctgtacatgcaataccgaatcccagtaccaaactggagtaaagctccatggggtctttccgtcctggcgcaggtaaccagcatcttcactggtacttcaatttcaccggatgcattgccgagacagcgctcaaatcattacgcctttcgtgcgggtcggaacttacccgacaaggaatttcgctaccttaggaccgttatagttacggccgccgtttactggggcttaaattcaatgcttcgtttcctgacatctcctcttaaccttccagcaccgggcaggcgtcagcccatatacctcacctttcggtttcgcatagacctgtgtttttgctaaacagttgcttgagcctattctctgcggcccgcttttacacgggcaccccttctcccgaagttacggggtcattttgccgagttccttggcaatgcttcttccgtcggccttaggattctctcctcatccacctgtgtcggtttacggtacgggtacgttacaaacaatagcggcttttcttgacgcatggctcacacacttccctactctagttcggtccgcatcacgcctttggattgtcacacggtttttcctatgtgactcctccttcgcttgccccgggattccattcccgggttgtgctttccacacgtgtccccacagttctgttctaacgcagtacaggaatctcaacctgttgtccatcggctacgtctttcgacctcgccttaggtcccgacttacccagggcagatcagctttaccctggaaaccttagatattcggccataaggattctcaccttattctcgctactcattccggcattctctcttcaatacagtccacagctcctttcggtactgcttcttcccgtattcaatgctcctctaccaatgtattactacattcctcagcttcggtgtcgtgttttagccccggacattttcggcgcaggacctctcgaccagtgagctattacgcactctttgaatgtatggctgcttctgagccaacatcctggttgtcttcgaaatcccacatccttttccacttaacacgtactttgggaccttagctggaggtctgggctctttcccttttgactatccaacttatctcgtatagtctgactcccgataatcaattccatggcattcggagtttgatattcttcggtaggctttgacgccccctaggaaattcagtgctctacctccatgtatctctatcgaggctagccctaaagctatttcgaggagaaccagctatctccgggttcgattggaatttctcccctatccacacctcatccccacccttttcaacggatgtgggttcggtcctccactgcctcttacggcagcttcaacctggacatggatagatcacccggtttcgggtctgcacatactgactctggccctattcagacttggtttccctacggctccacgcctctagcgcttaaccttgccagcatgcacaactcgccggaccgttctacaaaaagtacgcggttccgcatgtaaagcggttccacagcttgtaaacacagggtttcaggttctctttcactcccctcccggggtccttttcacctttccttcacagtactatgctctatcggtcactaaggagtatttagccttacggggtggtccccgttccttcccacaaggtttctcgtgtctcgtggtactctggatcctgtcttgtcctctttcctttcccatacggggctttcaccctctctggctggctttcccaaaaccattctggtagaatcaaggaatcaattatacagtccgaaccccagcatgcacgcacactggtttgggctctttcccgttcgctcgccgctacttaggaaatcgagttttctttcttctcctcggggtacttagatgtttcagttcccccggttcccctccatacgttatggattggcgtatggatacatgaggtcttctcatgtgggtttccccattcagatatctccggctcattggatatttgctcctccccgaagcttttcgcagcttatcacgtctttcatcggctcttagtgccaaggcatccaccctgcgctcttttttgcttggccattcagatcttatagcgttaacatctgacggctggtgttgcttggtttgtttctatttcttcgctgtatttctacagcgcctcgtttcgtctctatcttacgttttacgtattttagatgtttcgtatatgcagttttcaaggtacgactacggcagtaaaactttcgttttcttaccgagtggagataaagagattcgaactctcgaccccctgcttgcaaggcaggtgctctcccaactgagctatatccccatatttatttttttcctctgggtattacccagtgggcttaagtggactcgaaccaccgacctcacgcttatcaggcgtgcgctctaaccagctgagctataagccctcttttgtaatccggcagccacctgctttcccatgccgtctccagcatagtatcatcggccgcttaagtcttaaccatcgtgttcgggatgggaacgggtgtctcccctaagcgcatcgccaccggaaaggttttgttattaaattttagaagttttccttccttaataactcaacagtgaaacacttcttaactacttcttcttccttagaaaggaggtgatccagccgcaccttccgatacggctaccttgttacgacttcaccccagttatcaatcccgccttcggcagctccctccctaaggttgggtcactgacttcgggcgttactgactcccatggtgtgacgggcggtgtgtacaagacccgggaacgtattcaccgcgacattctgattcgcgattactagcgattccagcttcgtgcagtcgagttgcagactgcagtccgaactgggacgttatttttgggatttgctccccctcgcgggctcgcttccctttgtttacgccattgtagcacgtgtgtagcccaaatcataaggggcatgatgatttgacgtcgtccccgccttcctccaggttatccctggcagtctccacagagtgcccagcttcacctgctggctactgaggataggggttgcgctcgttgcgggacttaacccaacatctcacgacacgagctgacgacaaccatgcaccacctgtcttctctgtcccgaaggaaaggttccattacgaaccggtcagatcgatgtcaagacttggtaaggttcttcgcgttgcttcgaattaaaccacatgctccaccgcttgtgcgggtccccgtcaattcctttgagtttcattcttgcgaacgtactccccaggtggaatacttattgcgtttgctgcggcaccgaagagctttgctccccaacacctagtattcatcgtttacggcgtggactaccagggtatctaatcctgtttgctccccacgctttcgagcctcaacgtcagttaccgtccagtaagccgccttcgccactggtgttcctcctaatatctacgcatttcaccgctacactaggaattccgcttacctctccggcactcaagaaaaacagtttccaatgcagtcctggggttaagccccagcctttcacatcagacttgctcttccgtctacgctccctttacacccagtaaatccggataacgcttgccccctacgtattaccgcggctgctggcacgtagttagccggggcttcttagtcaggtaccgtcattttcttccctgctgatagaagtttacataccgagatacttcttccttcacgcggcgtcgctgcatcagggtttcccccattgtgcaatattccccactgctgcctcccgtaggagtctgggccgtgtctcagtcccaatgtggccgttcaccctctcaggccggctactgatcgtcgccttggtgggccgttacccctccaactagctaatcagacgcgggtccatctcataccaccggagtttttcacaccgtatcatgcgatactgtgcgcttatgcggtattagcagccgtttccaactgttatccccctgtatgaggcaggttacccacgcgttactcacccgtccgccgctcagtcccttacatcttcccccgaaggttctgtcgtaagcgcttcgctcgacttgcatgtgttaagcacgccgccagcgttcatcctgagccaggatcaaactctctgatatagtgtttgtccaagttcaagataactacttggccatctatcccttttactgttttggttcatcgaaccgttcttttttaaataaatgaatgtaaaagaattttcgttttcatgtgtttcactgttcagttatcaaggttcctgtcgttctttttatcagcgacagcttttatattatatcaaagctgtttttgtttgtcaagaacttttttaacttttttcaaagttttttatttttgatttgttgtcgttttcctcgacatcttttatattatatcaaagctgtttttgtttgtcaagaacttttttacttttttttattccaagtaattctttttcttgtcgcaacagcttatttagaataccatatctaacataacttgtcaacaactttttcaatttactgataatttagattaagttctgtatttttcagtcatttgttagtgacaactctgatactatatcacagcctttctctgtttgtcaactagatttttaacaaacttttctttttcatttcgttttcattatattcgattttccgaatctctttttttgtatgcttgacaggagatttctctaatgctatactcaactttgaaattttatataatagacagttcgtttgcaccatcctgtctttaaataaaaccagggctatgtatattgtttcattctttgacatgatgcccattttgtgcatcatgtctttttaattttaaagaaatttctttattatcaaaaacaatatccatatccgtaaacgaacggaaaggatgattatgtatctattaaaaacagagcagacttttgactccgctcactttctttctgattatcaaggcaaatgtcgtaatcttcatggacaccaatggcgggtaatcgttgaaatctgtggcaaaactttaagcactgatactcagacccgcgatatgcttgtagactttggtgatttaaaacatgacttaaaaacagaaactgatttttttgaccatgctttaatcattgaaaaaggcagtcttaaacctactactttaaccgctttacaggaagaaaatttcaaaattgttgaactcccatttcgaccaactgcagaacgcatggcatcttatttttatacaaaaatgaaattccatggctacactttaaggcgggtaaccgtatatgaaaccccaaaaaactgcgcgatttatgaggagtaatcaaactatgtcaactcaagcgatttatgatgttgttgaaatttttacaagtatcaatggagaaggtccattggtcggacaattggctgtttttattcgaatgaaaggatgtaatctttcctgcagttactgcgataccaagtgggcaaacgaaacagatgcccctgcaagagaaatgacggcaaatcaaatttatcaaaccattttagaatccggtattaaaaatgtcaccttaactggcggagaacccctttaccgtccttttataaaagaactcttaaaacttctggcatctgattcttctcttcatattgaaattgaaacaaacggaagcataaaccttgaaccattttgtgatttaggaacttctgtttcttttactatggattacaaactctcatgcagtaacatggaacaaaagatgtgtttaaataatttttctattttagagccaaaagatacagtaaaatttgttgtaggttcacttgcagattgtcaaaaagcatttgaaataatacagtcctatcaattagaaggtcgatgccacatttatctcagtccagtgtttgggatgattgaaccctctcagattgtagaatttatgaagcagaataaaatgaatggtataaatcttcaaattcaaatgcataaggtaatctgggaccctgaagaacgaggcgtttaactatatattccgagaatacctaaatttattttcatgatggaggttatttatttatgaaagctttagtattatccagtggcggggtagacagcacaacctgtttaggtcttgccatagaaaaatatggaaaagaaaatgtgattgcacttgcaattacttacggtcaaaaacataccaaagaaatcgaggcagcgagagctgtcgctgattattacaatatagaaatgttacattttgatttgtctactatttttcaatatagtgactgttccttgttaagtcattcttctcaggaaattccagaggaatcttattcagaacagctaaaacattcggatggaaaaccggtttctacttatgttccatttcgaaatggtctgtttctttcctgtgctgcaagtatcgcactttcaaaaaattgtgatgtaatctattacggagctcacagtgatgattcagccggaaatgcttatccagactgtagtgatgcatttcaaaatgctatgaaccaggcaatttatgaaggaagtggacatcaattaaaaatagaagctccttttgtaaatctaacaaaagcggatgttgttcgtaccggacttgacctgcatgttccttatgaacttacctggagctgttacgaaggtaaagagaaaccttgcggtcattgcggaacttgtattgaccgtcaaaaagcatttgaacaaaatggtgtaacagaccctgctctcgcttaaatataatatattgcaaaaaaatctagactgttcccttattattaattgatattatcgacagcctagattttttttaattttcagtatacacaaaaaaccacctatttatcatagatggcttcccaaataaaaaagctccccctgttggactcgaaccaacgacactgcggttaacagccgcatgctctaccgactgagctaaggaggaatattcattcatcgtaccttcaaaactacatatacaaaaccgaaaccatgcagacacttgccgctccgctgatttctcagcttctggtcaagccctcgaccgattagtagcagtcagctccatacattgctgcacttccacctctgccctatctacctcgtcgtcttcaaggggtcttacttctcacgaatgggatatctcatcttgaggggggcttcacgcttagatgccttcagcgtttatcccttccaggcttggctactctgccatgcagttggcactacaacagatacaccagcggcctgtccatcccggtcctctcgtactaaggacagctcctctcaaatatcctacgcccacgccggatagggaccgaactgtctcacgacgttctgaacccagctcgcgtaccgctttaatgggcgaacagcccaacccttgggacctactacagccccaggatgcgatgagccgacatcgaggtgccaaaccactccgtcgatgtgaactcttgggagtgataagcctgttatccccagggtagcttttatccgttgagcgatggcattcccacttaataccaccggatcactaagccctactttcgtacctgctccacccgtcggtgtcgcagtcaagctcccttctgcctttgcactcttcgaatggtttccgtccattctgagggaacctttgggcgcctccgataccctttcggaggcgaccgccccagtcaaactccccgcctggcattgtcccaccgccgggtcacggcggctggttagaaacccaatactgcaagggtggtatcccaacatcgactccgtagcaactggcgtcactacctctcagtctcccacctatcctgtacatgcaataccgaatcccagtaccaaactggagtaaagctccatggggtctttccgtcctggcgcaggtaaccagcatcttcactggtacttcaatttcaccggatgcattgccgagacagcgctcaaatcattacgcctttcgtgcgggtcggaacttacccgacaaggaatttcgctaccttaggaccgttatagttacggccgccgtttactggggcttaaattcaatgcttcgtttcctgacatctcctcttaaccttccagcaccgggcaggcgtcagcccatatacctcacctttcggtttcgcatagacctgtgtttttgctaaacagttgcttgagcctattctctgcggcccgcttttacacgggcaccccttctcccgaagttacggggtcattttgccgagttccttggcaatgcttcttccgtcggccttaggattctctcctcatccacctgtgtcggtttacggtacgggtacgttacaaacaatagcggcttttcttgacgcatggctcacacacttccctactctagttcggtccgcatcacgcctttggattgccacacggtttttcctatgtgactcctccttcgcttgccccgggattccattcccaggatgtgctttccacacgtgtccccacagttctgttctaacgcagtacaggaatctcaacctgttgtccatcggctacgtctttcgacctcgccttaggccccgacttacccagggcagatcagctttaccctggaaaccttagatattcggccataaggattctcaccttattctcgctactcattccggcattctctcttcaatacagtccacagctcctttcggtactgcttcttcccgtattcaatgctcctctaccaatgtattactacattcctcagcttcggtgtcgtgttttagccccggacattttcggcgcaggacctctcgaccagtgagctattacgcactctttgaatgtatggctgcttctgagccaacatcctggttgtcttcgaaatcccacatccttttccacttaacacgtactttgggaccttagctggaggtctgggctctttcccttttgactatccaacttatctcgtatagtctgactcccgataatcaattccatggcattcggagtttgatattcttcggtaggctttgacgccccctaggaaattcagtgctctacctccatgtatctctatcgaggctagccctaaagctatttcgaggagaaccagctatctccgggttcgattggaatttctcccctatccacacctcatccccacccttttcaacggatgtgggttcggtcctccactgcctcttacggcagcttcaacctggacatggatagatcacccggtttcgggtctgcacatactgactctggccctattcagacttggtttccctacggctccacgcctttagcgcttaaccttgccagcatgcacaactcgccggaccgttctacaaaaagtacgcggttccacagcttgtaaagcggttccacagcttgtaaacacagggtttcaggttctctttcactcccctcccggggtccttttcacctttccttcacagtactatgcactatcggtcactaaggagtatttagccttacggggtggtccccgctccttcccacaaggtttctcgtgtctcgtggtactctggatcctgccttgtcctctttcctttcccatacggggctttcaccctctctggctggctttcccaaaaccattctggtagaatcaaggaatcaattttgcagtccgaaccccagcatgcacgcacactggtttgggctctttcccgttcgctcgccgctacttaggaaatcgagttttctttcttctcctcggggtacttagatgtttcagttcccccggttcccctccatacgttatggattggcgtatggatacatgaggtcttctcatgtgggtttccccattcagatatctccggctcattggatatttgctcctccccgaagcttttcgcagcttatcacgtctttcatcggctcttagtgccaaggcatccaccctgcgctcttttttgcttggccattcagatcttatagcgttaacatctgacggctggtgttgcttggtttgtttctatttcttcgctgtatttctacagcgcctcgtttcgtctctatcttacgttttacgtattttagatgtttcgtatatgcagttttcaaggtacgactacggtagtaaaattttcgttttcttaccgagtggagataaagagattcgaactctcgaccccctgcttgcaaggcaggtgctctcccaactgagctatatccccatatttacttttttcctctgggtattacccagtgggcttaagtggactcgaaccaccgacctcacgcttatcaggcgtgcgctctaaccagctgagctataagccctcttttgtaatccggcagccacctgctttcccatgccgtctccagcatagtatcatcggccgcttaagtcttaaccatcgtgttcgggatgggaacgggtgtctcccctaagcgcatcgccaccggaaatatgttgttatctgttttttattgataactcaacagtgaaacacttcttaactacttcttcttccttagaaaggaggtgatccagccgcaccttccgatacggctaccttgttacgacttcaccccagttatcaatcccgccttcggcagctccctccctaaggttgggtcactgacttcgggcgttactgactcccatggtgtgacgggcggtgtgtacaagacccgggaacgtattcaccgcgacattctgattcgcgattactagcgattccagcttcgtgcagtcgagttgcagactgcagtccgaactgggacgttatttttgggatttgctccccctcgcgagctcgcttccctttgtttacgccattgtagcacgtgtgtagcccaaatcataaggggcatgatgatttgacgtcgtccccgccttcctccaggttatccctggcagtctccacagagtgcccagctttacctgctggctactgaggataggggttgcgctcgttgcgggacttaacccaacatctcacgacacgagctgacgacaaccatgcaccacctgtcttctctgtcccgaaggaaaggttccattacgaaccggtcagatcgatgtcaagacttggtaaggttcttcgcgttgcttcgaattaaaccacatgctccaccgcttgtgcgggtccccgtcaattcctttgagtttcattcttgcgaacgtactccccaggtggaatacttattgcgtttgctgcggcaccgaagagctttgctccccaacacctagtattcatcgtttacggcgtggactaccagggtatctaatcctgtttgctccccacgctttcgagcctcaacgtcagttaccgtccagtaagccgccttcgccactggtgttcctcctaatatctacgcatttcaccgctacactaggaattccgcttacctctccggcactcaagaaaaacagtttccaatgcagtcctagggttaagccccagcctttcacatcagacttgctcttccgtctacgctccctttacacccagtaaatccggataacgcttgccccctacgtattaccgcggctgctggcacgtagttagccggggcttcttagtcaggtaccgtcattttcttccctgctgatagaagtttacataccgagatacttcttccttcacgcgacgtcgctgcatcagggtttcccccattgtgcaatattccccactgctgcctcccgtaggagtctgggccgtgtctcagtcccaatgtggccgttcaccctctcaggccggctactgatcgtcgccttggtgggccgttacccctccaactagctaatcagacgcgggtccatctcataccaccggagtttttcacaccgtatcatgcgatactgtgcgcttatgcggtattagcagccgtttccaactgttatccccctgtatgaggcaggttacccacgcgttactcacccgtccgccgctcagtcccttacatcttcccccgaaggttctgtcgtaagcgcttcgctcgacttgcatgtgttaagcacgccgccagcgttcatcctgagccaggatcaaactctctgatatagtgtttgtccaagttcaagataactacttggctatctatcccttttactgttttggttcattgaaccgttctttttaaaataaatgaatgtaaaagaattttcgttttcatgtgtttcactgttcagttatcaaggttcctgtcgttctttcttatcagcgacagcttttatattatatcaaagctgtttttgtttgtcaagaacttttttaattcttctttttaagaaaaattaaacggagaaggagggatttgaaccctcgcaccgctattaacggcctactccctttccaggggagccccttcagccacttgggtacttctccaaatgcctaaatgatattttcatttagtgagcggagagagtgggattcgaacccacgcgcccttgcggacaaacggttttcaagaccgcctcgttatgaccacttcgatatctctccatctttgttttattctgtttgtttatcgctctgtgttagcgacaagtgatattctagcaccagttgttccaaatgtcaacactttttttgattttttttatttttttattttttccgtttttttattctttttgttttattttatcagggaaagatttcgccctctttccctgatatttactggaatttttaagctttttactcctgtttggcaaagtttttaaaagtgattctactcttcctctaacgtctccaaaatctgctccgcaagtaaaatatcttccggggtcgtaatttttatattatcataagccccttcttccaacttcacttttaatgaaccatattgttccattaccattgcatcatccgtaattccctgcattccttcctgctttgccttttgatatgccgaataaatttccggataggagaaaatctgaggagtctgaatattccagactcgagcccgttttggcgtagattctacaaatccctcttcatctgcaatttttactgtatcttttgatagtacgcctaaaacacacgctccgcctgcaatcaccgctttttttccgcgctctatcatttcctctgttacaaatggtcttgcaccatcatgaataaacacataatcacagttttgacatgccttaagtccttcataaacagaatcatagcgttcttttccacctgtaacgactgcttttaccttttggaatccaaacggctctacaatctctctttttacatattcaacgctttctgcacctgttacaataatgatatcatcaatttcactgctcttttcaaaacaagaaatactataaaacagaaccggtttcccttttaacaaaagaaactgcttctgtattttactcttcattcgttttccctggcctgctgccagcacaattgctgtacagttcatattatcgccccttatactaacgttctcccaatttcaggtttggaactgcatttaaatccattccatgtctcgttccctttaaaaattcgtaatacgcagccacaccaatcattgctgcattgtccgtgcagaaaattggtgatggatgataaaattttatctgattttttttacatgcttcctccatcgcactgcgaagtccgctatttgatgcaacccctccggcaatcgccagttttttaatatgataatcttttgccgccataattgcgtgttccacaagtacctcaaccacacagcgctgaaaagaggctgcaatatctgctgctacaatctcttccccctgcattttgcacttgtttaaatgatttaataccgctgattttaccccactaaagctaaaatcataaggagcatcttcaatcttggcctttggaaaatcaaacgcataaggatttccctcttttgaaagtttatcaattttcggtccacctggatatcccaatccaattgctcttgcaactttatcaaatgcctcacctgctgcatcatctctggtacgtcctaaaatttcaaactcaccataatcttttacaataaccagatgtgtatgacctcccgatacaaccagacataaaaatggcggttctaaatccagattttcaatataattggcagaaatgtgcccctcaatgtgatgcacgcctaccagtggtaaatcttttgcaaaactaattgcttttgcctctgccactccgactaaaagcgcaccgacaagcccaggtccataagtcaccccaatcgcatctaaatcatctaaagtaacccctgcttcttttagcgcctcttcaatcacctgattaattttttcaatatgttttcttgatgcaatttccggcactactcctccataaagtttatgaaggtctatctgtgaagaaatcacatttgataaaatagtacgtccatttttcacaacggatgccgcagtttcatcacaggaactttcaattgcaagaattttaatatctttttgtgtttctgtctccacgtttttttctcctttcccatgtactccattccaatgtacgctcgaaatttttctgttaaaagctctcaaaactcaaaacgtacctcaatatctacaatatctatctgatatcatcttaagtttctgctactcttcttcaaactgcagttctaccgactggcgatctcttgctgcaatcgtattttggaaaatttttgttgcctctcccaatgcttcttccggtcttaccagtgacggactgtaatgtgtcagccagagttcctttacattggcactttttgctaatgttgcagcttctttaaacgtcatgtgtttatgtgcctttgccttttcctcttctttatcctgctctccatacattccttcacagataaataaatctgagtctttcgcatgctcttctatagatttgaccggtctggtatctgtcgtataagtcagtttaattccctttcttgccggtcctaataccatatccggagtataaagcatgccatctgcctctactgtctcccctttttgcagtggattccaatattttaacggaatattctgttcctttgctctttttgcatcaaattttccatttctcttaatttctatcgtatatccataacaaagtacattatgatttactttatatgccgtaatctcatacccatataaagtaaaagtctcttccgactgagtcaactcaatacattcaatttcaaaaggcagttccggtgcaatcacacgaagcgcatttaccacacggacaagaccttttgggccaatcaaagtaagaggctcggttcgctctgcatttcccattgtcaaaagcagtcctggaagcccactgatatgatctgcatgataatgggtaaaacaaatcacatcaatcggcttaaaactccagcctttttcctttacagcaacctgagttccctctccacaatcaatcattaaattacttccgttatagcgtgtcattaaagcagttaattttcgtcttggaagcggcatcattccaccggttcctaacagacaaacatccagcatctatcttttatcctcatttctctctgattttgcagagatatctgcgttttttatcttaacacacatttttgactgctacaacaattccttttcttttttcacggtaagtggaattacaaaatctgcggttattctatcatagcacgcttcacataaatcaaattcatggtgttctgtatctttatttgaaaaatatccccataaaatctctccatgaaacattccttcctgaatcatttcgttttttatggttattttttttccacatccattacaataaatttctgccagttttttttctttttgatttttatattttctcatccttatcctccaaacggatgtcatatactttcaaactctctctttttgatttactttgtactctcgacttgtttcttctgtattataccgaatttttttcaaaaatcctatatgaaaccattttcaaatatagaaaaagatagcaattctgctatcttttacacataacgattccatcttcgaccggctcttcataaaactttttccgcacatcaatctcttcaaatccaaaggaacggtataactttcttgcacgtagattactctctcgcacttctaaaaagaaagacatcccccctctttttttcgcttcttttaaaaattcctccataagatgtgttccggctctttgtccccagcaggactttttaattgacacatttgtaatctcgccctcatctaatacaagccacattcctgcataaccaatgatttcatcttgattctcaatcaccatgtacaacgtatttttagaacgaactgcatcttcaaaatccttttgcttccacggctttgaaaaattttcagcttcaatttgagcagtttcttctgcatcctctattgtcatttcacgcacttttaataaattttttttgatattctcactcatgtttttcttgtttcaaacgttctgcacgttctctttctgcctgagaaacacgaagatactccggcttatgttctgctgcactttctgtttttccctctttaaaataaagagtaccaagcatgccaaccgcccctgcacgctgtctgcttaaatgtgccggtgcaaatgaatacggcactttacagctttcctgaatcaattctttataaaccggaacagcgtcgccaagaaaaattaccggtctttccatttgatttaattcttttatcaattcctctaatgcaactgcatcctgttcttttaccacctgcatctgatgatttaaaaagcaatacattcctgtataaacctgttttcttcttgcatccataatcggacagataatcgtatcttcatcggtatcatataaattataagctagtgcatctaccgtcggcacgctgattaacggcttatctaatgcaagtcccagtccttttgctgtcgccgaaccaattctaagccctgtaaaagaacctggtcctgctgccactgcaattgcatcaattgaacttaaattcaaatcaatactcttttttatttcttctaacatcggaagcaaagtctgggaatgtgtttttttataattcatcgtatactctgccacaagtgtttcttcttctatcacagccacagaagctacaagccccgaactgtcaattgctaataatttcattgtcttctctcctctctggtttcttgttctgcttttttattccatttctgtcttagctaaaccatctattgtgatttttcgataatcaaatcctttttccggatttttttcaattgtaattgcaatgatagactccggcaaaagctcttctattaattccgcccattcaatcaggcaaattcctttcccaaaaaagtaatcatcgtatccgatttcttccatttcttcaatatctccaattcgatagacatcaaaatgataaaatggaagccgaccgccttcatattcttgaacaatcgtaaacgtcggactgtttaccggttctttgattccaagtcctacagccactccttgagtaaatacggtctttccggttcccaaatctccatttaaggtataaatctgtcctgcaaccgctttttctccaagccgtttcccaagttcaaatgtttccttcgcactatttgtttctattatcatattttgactcactttctgtttctatacaaaatgacatcattttctgtttctttcatccgagcgagtattcgtcagaatatcgttacggtaaaacagacatttgcaatccgctttgttacttgctcaccacttagtgatctgcgcacttgaagcaggagaatgcttatctgcggtaaagcggacattcgcaatccgcttcgctacttgctcatgaacgcagtcgcttcgcgatctgtcagtgggagctttcaactcccactgacagaagcatccccctcacccgccgtttagtgctctgcgcacttgaagcggggggaatgcttatctgcgttcaaatctcgattctacattataacacagaaaattatggcttgcaccttttatttttccagattataatggtatctgaaccttttggtgctgccggttttattgttttgataagactttttaagtgcagtaacctgttcgcaaaaaaaattaaaggagatacaaattatggctaatccaattgtaaccatcacaatgacagatggcagtgttatgaaagctgaattatatccggaagttgcaccaaatactgtaaataactttattagtctggttaaaaaaggcttctatgatggtcttgtattccacagagtcatccgcggatttatgattcagggcggcgacccacagggaaccggaatgggcggtcctggctattccatcaaaggagaatttacctataacggtttttccaatgatttaaaacatacaccaggtgttctttccatggctcgcgcaatggatccaaattcagccggaagccagttcttcattatgcatgaaacttccccacatctggatggacagtatgctgcatttggaaaagtaactgacggacttgacgtggtaaataaaatcgctgaagttccaactgactacagtgaccgtcctcttgaaccacagatgattcagaacatgactgtagatactttcggagttgaatatccggaaccggaaacggtataattttatcagtcttcaaatgtaagaacttctttatcaagaatggcataatacagttctttttctgccgtgacagaagcttttccgctcgttgcttccgtcacggctttttttatgcgttcttcttcttttttcggaactaatacttcaaattctacactttctgtatatcttgaatctaaaatcggaagattctcctgcccaaacagatactgcagttttccgactccattataatctgttccaactaacagacatactccatggtttttggtaattaaaatactgttttttaatccttcctgaacggcttttgaatatgcccttacaagtcctcccgttcccagcagagttccgccaaaatatctggttactacaaccgcaatattatacagttcttctccaagcaaaacatcaagcattggttttcctgccgttccctgtggttctccatcatcactgcagcgcataaactcttttctttctccaatcacataagcatagcagttatgtctggcatcccagtatttcttttttatctcttcaataaattttaaagcttcttcttctgtttttaccagacggacagttgcgataaaacgtgactttttttctacgatttcgccctctccgccctgatagactgtcctatattgttctaacatctttcttatccttacctgattctttttaaattttcttcatcataccacagaaatttacaggtgcaaagcaataattttcccctgaaaagtatcaaaaagtgtgaattttatcaagttagactttatttcgcacagggcatttgctataataaaccggtaaaggaggcaaaatacatgaattttggaaaacgtgcgacaaacagaaaacgaaatgccctgtcctcccactccacaatgatagggaaaaaagcaaatgtttctgttctacgcattctgtttatttcactgattgcagtttttaccatctgcttatgcatcggggtaggagcttttcgaggtctgattgacagcgcaccggatatcaatgatgtcaatatcatgcctgtcggctctgcaactttcatttatgactcagacggcaatcagcttcagaaactcactgcgcctaattccaatcgtatgccggtatcgattgaccagattccacttgatttacaacatgcagttgttgcaatcgaggatgagcgattctacgagcataacggaattgacctccgcggtattatgcgtgccgctgtaaaaggtattacgcatggattcaatttttcagaaggtgccagtaccattacacaacagcttttgaaaaataatgtgtttaccgactggacaaatgaatctacaattgaacgttttaaacgaaaatttcaggagcagtaccttgcagtccagttagaaaaggaactgaaagacaaacagaccattcttgaaaattatttgaacacaatcaatcttggagatggaaattatggagtgcaggcagccgcacacggatattttaataaagatgtcaatgaactgaccctttcagagtgtacggttcttgccggaatcagccagaacccaacccgctataatcctgctacaaatcctgaggaaaatgcaaagcgtcgaaaagaagtactcgaccacatgcttgcccagaattatatctcgcaggagcaatatgatgaatgtcttgctgacaatgtttatgaaagaattcagcaggtagaggcagaaacttctcaggaagacaccacttacagttactttgtcgatgaactgaccaaacaggttgtcagtgacttaaagacccagaaaggatattctgaccagcaggcttacaatgcactttacagtggcggacttcgtatttatacgactcaggaccctaatattcagcagatttgtgatgaagaatattcgaatcctgccaactttccttctggtactcaggtggaactggaatatgcactgacaatccgccgtccgaacggaacggaagaaaacttcagtcaggaaatgatgcagtcttatttccagcagcaggaaggagaaaatttcaatctgctctttgacagcgcagaacaggctcagaattatatcgacacctacaaagctgctgttacctatgatggctctgaagtgctctcagaaagcattacaatggcacctcagccacagtcatctgtggtaatcatggatcagcacaccggatatgtaaaagcgattgtcggcggacgcggggagaagaccagcagtctttccttaaaccgtgcaacatccactctaagacagcctggttctactttcaaattagtatccacttatgcacctgctttaaatgaatgcggaatgactcttgcaaccacttatacagataaaccaatcacttataaagacggtacaccggttaagaatgcaacaaattcttatcgcggagaaacaaccatccgcgaggcaattattcattctattaataccgtagctgttcagtgctttaccgatgtcactccacaacttggatatgagtatctgaagaaattcggatttaccactgtttatgacaatatcagtattaatggtaagatttatactgacattcagcagccaactgcgctgggcggtattacgcgcggtgtcagcaatctggaactgactggcgcttatgctgcaattgctaattccggaacttatatcaaaccaatgttttatactaagattctggatgaggacggaaatgttgtcatcgacaacactccggaagaaagaaaagtcattaaaccaagcactgcttatcttttaaccagtgcaatgaaggatgttgtaagcgaaggtaccggtacaagacttcagctttctaatatgcacgttgcaggtaaaaccggtacaaccgatacctacaatgatgtatggtttgcaggattcacaccatattacacctgtacaatctggtctggatatgacgataacaccaagatcccggataccggaaattacagaacctatcatcaggacttatggaatcgtattatgagccggattcatgaaaatctcgaagataaagattttgacaagccggctactgttggtgaagcaactgtctgcaaagacaccgggatgcttccaacttacaattgtccgactgtaacagaactgtttgataccaccgaacttccaaccaagcgctgtaccaaacatggcggtggtggtagcagccgaagctatagttcttacagttcaagaaattcctacagttattcggataatgaagatgacgacgaagaagatgataccgattcttcttcctctgatgacgaggaagataataccgataacgaagaagaataaactgtaaaaatttaaaaacacaacaaaaaagactccgttctcgaaaaagttgagaacagagtctttttatttactatcctgattttttactacaatcttcttaattatctttgcttaaaattaattttgcagctccataaattccagcatcatttcccagtgttgccagtttaatcggagtttctttgcttgcagtaaatgcatgtgctttataatatttttctactgcatcaattaaaacttgtccggcttttgataccccaccaccgattacaaatacatcagggtcagaaacacaggcgaatacagccagtgcattgccaagataagcagcaaatttatcaacaattttacctgccagtacatccccttctttataggcatcgaatacactctttgctgaaatattttttacagttctaagcacagaatcttctgcttcactttccagcgcctcttttgcaagacgtgcaataccggttgcagaagcatactgctccagacaacccttatttccacagttgcatgctttggtttctgccggatttacaaacgcatgaccgatttcaccacctgctccgtgtgctccggttacaattttttcatttatgatgattccaccgcctacacccgtacctaaggtgaccagaatcaggttctttgcaccctgtccgccacctttccacatttcaccaagcgctgcaacatttgcatcatttccggcttttactgcaagtccggttaaatcaccaagttctttttcaatattttttcttccccaatgaagattcacggcgcatggaatttctcctgtttcttctaccggtcctggtacaccgattccaacacctgcaacttctgccttatcaattttcttttcttcaatttttgcaagaattgttgccgctatatccggaagaattgcttctccattattttctgtacgggtcacaatctcccatttttcttctactgttccatccgtctgaaacagtgcacattttacagttgtaccaccaaggtcaattccaaaacaccacttttccattattcatcttcctcttttctcttttttgacatattttcctgtacacgacgatacagttcctgagctgcattatagcccatcttcttctgtctgtggttaaccgcagccgactctacaataacagccagatttctacctggacgaattggcagagaatggcatactacacggtttcccaaaaattcagtatactcttcttccaatccaagacggtcatattctttgtctttatcccactcttccagcttgataaccaaatcaatagactgagtatcttttacactttctacaccaaacagggtctttacatcaataattccaataccacgcagttcaataaagtgacgggtaatatccggtgcagagccaaccaatgttgcatcactgacacgacgaatttctacaacatcatcgctaaccagacggtgaccacgtttgattaactccagggcagcttcactcttaccgattccactttcacccataatcagtacaccttcaccatatacatcgactaatacgccatgaatggaaatgcacggtgcaagctctacattcaaccaacggataatctctgccataaaggtagaagttgtctggtcagttacaaaaatcggcacatcatatttaattgcaagattaatcatatcttcatccggttctgtctttgtactgaaaatcacacacggaattttacttgctacaaaacgttcaaacgcttccatcttcttttctctggataaatgcagaagatatgtgtattctacatatccgataatctgaactctttcattttcaaaatgttccagatatccggtcagctgtaatgctggacggttaatatccggcagggtaatcctcttttttgagatatccacatccggtgttttattatgcagatttaattcctgcaccattttgcttaattgtacacctttcactttttaggcctccttgttttccctgaacgcaaccttatgataaactattttttgcgcacattcgctttgataatagtttatcataaggtgtttagaagttcaactgcaaccatatcaagaattcgtcaacttatgccgtcaaaatcatatgtcagttcttacaaatgtttaacttaaatttcacgcatttgctttatgaaaaaagtcatacactgcctgcgctgacttttcattcatcgaagaaacttcagccagttcttccactgttgcctcttttattttttccacacccataaaatgtttcatcaaagcttttcttcttgccggaccaatcccttcaatctcatcaagcacagaatgaatctgatttttacttctcaaagaacgatgatattcaattgcaaaccggtgtgcttcatcctggattcttgtaatcaatcgaaacgcttcactgtctttttcaatcggaatttcctgattttgataataaagacctctggttctgtgtttatcatcctttaccattccacaaaccggaatctcaagttttaatttttcaagcacggacaacgcagaatgaacttgtccctttcctccatccattagaatcaagtccggaaatttcgtaaagcttccatactgttcttcctgatttttttcttcttgctgttgtttttcttccattccatgttcaaatcgtcttgtcagcacctcttccatgcttgcataatcatttgaaccttccacagtctttatccgaaatttgcggtaatcactccgctttggttttccattttcatacacaaccattgaaccaaccgacaaaaatccactgatattggaaatgtcataagcctccattctctgcgtacttgaaagatttaaaagtttactgatttcttttaccgccccgatggttcgtccttcttcccgctttaatcgttctttatctttttcaagtaccagcctggcattattttttgcaagttctactaatttttcttttgttcctttctttggcacacgaatctgtacctttgttcctctgcggtttgaaagccaggtttcgattattacacgatcctcaatttcgctctcaatcataatttcctttggaatcattgcagttcctgcataaaactgtttgataaaactcgataaaaccactgctttttcttctcctgccgtgtgtaaaaagaaatggtctcttccaatcatttttcctccacggataaaaaatacctgagctactacatcgtcattttcctgtgccactgcaatcacatccctatcttctccatgctggtctgtgattttctgacgctctgcaatcttttttacgctctctatcaaatcacgatactgtgccgcatcttcaaaacgcagttcttcggacgcccttaacatcttttgttccagttcttttaaaatttctttatgatttccattcaaaaacgaaatcagctcttctacctttttatgatactcctcttttgaaatatacccctgacaaggtgcctcacactgatgaatctgataatacagacagggtctttcttttttgatgtcctttggcagatttcggttgcaggttcttaaatggtatagttttgttacaagctccaccacatcttttactgcaagaccgctggtatacggaccataatactttgctttatccttcttcatctgccgtacaatctgaatcctcggatattcttcctgcaaagttactttgataaatggataagtcttatcatcctttaacatggtattatattttggtttgtgttctttaattaaattacattccaataccagtgcctctaactctgaatccgttacaatgtattcaaatcttgcaatctgttccaccatctgttctttctttatccccagatttcgactgctttgaaaatactgccgaacacgattttttaaactgattgcctttccaatatagataatcgtatcctctgcatcatgcataatataaacccctggttttcccgggagcttctttaattcctcttcaatacaaaacaatttttcccatcctttctccctgtattgaaagaagctatcacattcctgcgatagcttctctgtttctttaatcgtttctttaatcatttaattcgtttttagccagtactacttttggtgtttccttttcttccaccttattttctacgatacgcggtttttcttttggttcgctttctcccttgatttcacggaaaatcttcataaattcttttccggtaatcgtttctctttcaatcaagaattcggcaatcttatcaagcgcttctcggttttcgcttaaaagccgttttgcttcatcgtaggaatattttaacaatttcataacttcatggtcgatttctgttgcagtggaatctccacagttcatcacggctctgccatcgagatactggttctgcgtttccgcaagtcccatcagaccaaagcgttctgacataccatattgagtaatcatggctcttgccactttggttgcctgctcgatatcatttgctgcaccggttgtaacggtatcaaatacaatttcttctgctgcacgtccgccaagataaccaaccagcattgcctcgagttcttttttggtatttaaatatttctcttcttccggaacatgcattacatagccaagtgcgcccattgtacgcggtacaatcgtaatcttctgtaccggctcagaatctttctggagagcgctgaccagtgcatgtccgacttcatggtaagaaacgattcttctctcttccatgcttaagatacggtctttcttttctttaccaactaatacaacctcaacggcttctaataagtctttttgcgaaaccgcttttcttccattttttacagcaagaatggcagcttcattaatcatatttgcaaggtcagatccgactgctcctgaagttgcaagtgcaattccctctaaatcaacagtttcatctaaagatacatttttcgcatgtacttttaagatgctgacacgaccttttaaatccggacggtctacaataacacgtctgtcaaaacgtcccggacgaagcagtgcagggtctaagacttccggacggtttgtcgcagcaagaatcaaaagccccttagaagtatcaaatccatccatttctgctaacaactgatttaaagtctgttccctttcgtcattgcctccgaaacgggaatctcttgttttaccaatcgcatccacctcgtcgataaaaataatacaaggtgcatttttctttgcttcttcaaataaatcacgtactcgtgatgcaccgacaccgacaaacatttccacaaagtctgaaccagacaatgagaaaaacggtacgtgtgcttctccggcaactgcctttgcaagcagggttttaccggttcccggaggtcctaccagcagtgccccctttggaagttttgcaccaatctcggtatattttccgggattatgcaagaagtcaacaacttcctgcaaggattcttttgcttcatcctgaccggccacatctttaaatgtaactcctgtttctttttgtacataagcttttgccttactcttgccaacaccccccatcataccaccgcctttattcatacggcggaagaataatgaaatcagtgcaaacattagtacaaccggcacaacaaaacttaaaattgcatataagagttctcctgccatgtttggtttttcacgtttgaactctacatttgcctcatcaagtcgttttgtcaactcattttcatcttccgtggcaataacggtttttgtgccattccctaatttcccactgtttttcaacgttactttcaaatcatcagaatttatcactacactttctacctgacccttatcaagcagttggataaactcactataggaaatttcgctggatacattacttgtcattctggacagcatattcattccaaacagactgaccataatacagattaaaagtaccagaagggattgtttattcttaggtcccttattattattcgggtcctgattgcggttttgattttgatccatcttattcctcctcattctgtcctttctattatacgaatagcttgttaaaaaatcaattaaaaaactcgcttcaaatctaaaactttcatgaatttatttgttattctgccaaaagtttcttttttttgtttcccctactagaattttgcctgctctttgtagtataataaattttgtatgagtaaaaacagagtaaaaagaaaggcataaagaaaatgaagataggatttgataacgaaaaatatttatctatgcagtctgaacacattcgtgaacgcatcaaccagtttgacaacaaactgtatcttgaatttggcggaaagctttttgatgactatcatgcatcaagagttcttccgggatttgcaccggacagcaaactgcgcatgttaatgcagttagccgaccatgcagaaattgtcattgtaatcagtgctggagatattgaaaaaaataaagttcgtggtgaccttggtattacttatgatgctgatgtactgcgtcttagagaagtttttcaggagcgtggactttatgtcggaagcgttgcaatcacacagttttccggtcagccggctgctattaatttcaaaaagaaactggaaaaactcggcatcaaagtatatattctctactccattgatggctatccaagcaatattccgcttattgttagcgatgaaggttatggaaaaaatgattacatcgaaacaacaagaccacttgtagtcatcaccgcacctggacctggaagtggaaagatggcaacctgcctctcccagctctaccatgaacataaacgtggagttcatgcaggatatgccaaattcgagactttcccaatttggaatattccgttgaaacatcctgtcaatttagcttatgaagctgcaactgccgacttaaacgatgtcaatatgattgacccgttccacttagaagcttacggtgaaacaacagtaaactacaaccgtgacgttgaaattttccctgttcttcgtgcaatttttgaccgtattttcggaaaatgcccatatcagtccccaactgacatgggggtcaacatggccggaaactgtattattgatgacgaagcctgctgcgaagcatcccgtcaggaaattatccgtcgttactatcaggcagtagacggacttgcagatgagactaagacccaggacgaagtgtttaaaattgagctgttaatgaaacaggcaaatatctccttagaagatagaaaagtaacggttgccgcaaaaaaacgtgccgaagaaaccggagcacctgctgctgcagtcgaattagacgatggacgcatcattacaggaaaaacttctgatttacttggtgctgcttctgcgctcttattaaatgcgttaaaagaccttgcagggcttcctcacaatcttcatgtaatttctccggcttctattgagccaatccagaaattaaaaacatcctatcttggcagcaaaaatcctcgtcttcatacagatgaaattttaattgcactttcaagttctgccgcaaccagcgacgctgcaagacttgcattagaacagcttccaaaattaaaaggatgccaggttcattcttctgttatgctttcttcaactgataaaaaaacattccagaaattaaaaatgcaggtaacctgcgaaccggtttttgaacgtaaaaaactatattaagatttcaaaaaggggcagacacagctaatccgctgtatctgcccctttcctttttgccaattttaccaatcaaaattatcaattaatcatcataaccattcgggttattagactgccatctccaggaatcttcacacatttctttgattccatattctgcggtccatccaagttcttcttttgctttttctgcacttgaatagcaggttgcaatatctccaggacgacgtgctttaataacataaggaatttttacacctgttgcagcttcaaagttctttacgatatcaagtacgctgtaaccttttccagttcctaagttataaatcttaagacctgctttttcttcaattttcttaagtgcttttacatgtccttttgcaaggtctaccacatggatgtaatcacgtactcctgttccatccggtgtatcgtaatcatttccgaatacacccagctcttttaattttcctactgctacttgagtgatgtatggcattaagttattcggaataccgtttggattttctccgattgttccgctcttatgtgctccgattggattgaaataacgaagcagtactacgttccattcagggtctgctttctgaatatcggttaaaatctgttccagcatagattttgtccatccataaggattggtacactgtcctttcgggcattcttctgtaattggaacaaatgcaggatctccatatactgttgcggaagaagagaaaataatattttttactccatgttttctcattacatcaactaaagttaaagtacctgcaatgttattttcataatattcccacggttttgccacggattcaccaactgcttttaaacctgcaaaatgaatacaggaatcgatggattctttctcaaatacttcatttaatgcatctctgtcaagaatatctgctttatagaaagtcaccggttttcctgtgattttttctactctctccagtgatttttcactcgcattacttaagttatctaaaacaaccacatcatagcctgcgctctgcagttctactacggtatggcttccaatatatcctgctccacctgttactaaaattgccatttgttgttcctccttttaaaacctctaagttttctgtttagaaacatcttttatgttctatattactttaccatttttttttgaaaaagaaaagccttaatttatttttcccataaatattccggatacagaccttctgctttcatacgtttaattgcagccacaactaccggtttgtcttctttataggttacaccataccatttatctgtagattttaaaacctgaacagtcgctttttcttctgccagcagttctccgactacagaaggcaggaagtattcacattttaacggattcttttccagattttcttctaagaatttcggaaaacgattttttaactctgtcagcatactcggtgtaaatccccacatattcatggatacaatactgtcatttggaagtgctgtccatgtttcgccatcatcttccgtatattctgcctgttccccatgtttttcaatacgggttctctcacagattcctaccagatgaccgttttcatccgtctcgcagactcctcttgccacatgtccgttttcggtcaatgtattttccagcacatagccaaccatagtatagcggtatttttcatcatcttcgtgtgtggttaagaaatcatagattacctggaatgcatgagaaccatagtagtcatctgcattgataactgcaaacggagcatccacttcgttaatacagcttaagatagcatgacctgttccaaatggtttgacacgtccttcaggaacggtaaatccttccggaatgttttccagtttctgatagacataacttacatcaatcactttgcttaagcgatcaccgattgctgctttaaagtctttttcattttcctcttttataataaatactacttttttaaatcctgcttttactgcgtcgtaaatggaaaagtccataatgatatgaccctgttcatctaccgggtcaatctgttttaatcctccgtagcggcttcccattcctgctgccataacgaccaatatcggatttttcataatctatttcctccttataaaatcatcagatttctttctaattttaccacataactatctgtatcgtaaagctgacttgaatttctcaacgaaaaaagagccatttcttctaatttcgattcttatttattttatatttttatcttatattaattaaagcagacttaaaagctgtccactgaaattaattacaaaatgtaaatacatcgatgctttcaaagttccataacgttttactacagcaccaagtaccatccccaataaaaacgcatagattccctgtaccagattcagatgaatcataccaaaataaaatgcctgaatgatatttgccacccagaatggaaactcttttcttaaaatcacaaggcagagccccctcataagcatttcctctacaatcggtgccgtaatcaccacataaaatacagaaaagagactcggatttccacttcccagactctccattacttttgtataattctgcatcaaatccggtcgaacgatatacacaagattcaaaagaaaactgattgcaaactggacaaaaattcctaatactgcaagttttaaaagaaccgacagattcagattcttttgttgattccagaccggatattttccgcctgcccgcatccgtttataccagaataccccaatcacaaaaaatataaggtatgccagaatactaatcaggtacagcccttcctgttctaaaaatccagaaagccagttaccaaatactgttcctgacaccgcagtcattccaatcattcctgtaaaagtacagccacatgaaacaagaatttctattataaaataaactgcaatcggtgtcagacttaataataatgtctttatctttctgctcataattctttaaagtgaaactggctgtttccctgtgcataatctgccacaatctgtccctgtccgtataatttatatttataagtaacaagcccctccagtccaaccggacctcttgcgtgaatctttcctgtactgattcctacttctgctccaaatccataacggaatccgtccgcaaatcgggtagaacagttttgataaacccctgcggaatccactaactgcataaatttttctgcaatttcctgattttctgtaagaatacaatccgtatgatgagaaccataatgattgatatgtgcaatcgcttcttcttcgtcttctaccagtttaactgaaatcaccaaatccagatattctgtatgaaattcttcttctcccatcacttcacaagaaatgatttcactaacttcttttgttccacgaattttcactcctgcctcttttaaagcagtttcaagttccggtaaaaattcttttgcaatttctctgtgaaccaataaggtttccaccgcattacaggctgccgtatattgagtctttgcatccacaatcaccggaatggctttctttttgtcatactctttgtctacataaatatggcagacgccgtctgcatgtcccataaccggaatctttgtatgattcataatatactgaacaaaagaatttgaacctcttggaatcaataaatcgaccgattcatgacaggataagagttcatcaatctcattatgttgttctgcctgaagcatacagccttccggcactccgaccgaagttgctgccttataaataatatcaaacaaaatcttattggttcttgcagtttcttttccaccttttaagatagcgcagtttccgctttttaagcaaagcgaagaaatctgaaccagcgcatccggtcttgcctcaaagataattccaatcacgccaatcggacaactcacacgataaagatttagtccatcatctaactgtcgtgccagctgtacttttccaagcggatccggcagtttgattaattcgctgattccgtttactacatccatcagtttgtgttcatcaaatttcaggcgttttttcaccgccggtgcgattcccattttttctgcagcttccatgtcttttttattttccagaaaaattgcttccctatttaaaaggagagcctcctttaccttttcaagtgccagatttctctgcgcttctgaaagtcccgccagctttgggctgtcctgcttcatcttttttgttgcttctttcatattcatactgccgattcctcctgattttcggggataattttacttcttaccgctcattatagctcgaatttcctttgcttgcaatcccaattggaacaaagtacatcatgtacccaattttaccaaatgaaaatctaaattttttcataatccttatttaaaaatagacatagcagtgctataatgttcacacggcatatcatagtgatatgcaatttttcatattctttaattggaggattttatgaacattattatagtagggtgtggaaaagtcggacgcacccttgccgaacaactcagcaatgaaaagcataatatcgtcattgttgatattattgagaaaaaaattcaagacactaccgaagacatcgatattatgggatttctcggaaatgcatcaagtatcaatacccttctcgatgccggaattgaaacagcagaccttttaattgccgtgaccggttctgacgaactaaacctgctttgctgcctgatcgcaaaaaaggtaagcaaatgccacactatcgcaagagtgcgtaatccggtctacagcaaagaacttggatttctcaagcagagtctcggaatttccatgattattaatccggaacatgctgctgcgattgaaattgcacgtatcttacgttttccatccgcaattaaaatcgacacctttgccaaaggccgtgtggaattattaaaatttaaaattaagccggaatttaaattaaacaatatgtccgttatggaatttggtgaacgctataaaaacctgattctgattggtgcagtcgaacgtggagaagaagtcagtattccatccggtaattttattttaaaggataatgatactgtgtctgtcatcgcttcaccaatcaactccgctttgttctttaaaaaaatcggaatccatacacatcaggtaaaaagcaccatgattgtaggcggtggtactctttcttattatcttgccaagattctcttaagtatgaagattcgtgttttaattgtggaatccaacgctgcccgctgtgaacagttaagtgaattattaccggacgctaccattatccacggagacggaaccgataaaaatctgctcttagaagaaggattgacccgtgtggaatcttttgttactttaactaatctggatgaagaaaacatcctgctttctttatttgccaagaaaaacagtaatgcaaaattggtttcaaaagtaaaccggattgcgtttgatgatatcattgaaggtcttgatatcggaagtgtgatttatccaaaatacattactgccgattatattcttcaatatgtccgtgccatgcagaacagtatcggaagcaatgtggaaaccctttatcagattcttgataataaagcagaagctcttgaattttccatccacgatgactgtccgtttttaaatatcccgctggctgacttagatatccgcgacaacctcttagttgcctgcattaaccgaaatggtgtcatcctgattccaagaggtcaggactcgattcaggcaaaagatacagtcgttgttgtcactacaataaaaggactcaatgatattcaggatatcctgaaaaaatagtttactttattactaaaaggaaaatcaaattatgaattattcgattattgcttatatcattggatggattttaaactttgaagctttatttatggcacttccctgtataactgcaattttctaccatgaacattccggctgggcatttttcttatctgctatgttctgcctcttaattggaattccactggtacagaaaaagacaaaaaataaaatcttttataccagagagggctgtgttacagttgcactaagctggattatccttagtattatgggtgcacttccatttttaattggcggtgttatttcaaatccaattgatgccgtatttgaaaccgtctccggttttacgactaccggtgcaagtattcttctggatgtagaatctcttccaaagtgcatgttaatgtggcgaagttttactcactggattggcggtatgggtgttctggtctttattctctgcctgcttccattaacaggaggtgacggcggttatcatgtcaacctgatgaaagccgaaagccctggaccatctgtcagtaaactcgttcctcaggttcagtctaccgccaaaattttatattcgatttatctgactttaaccgttatcgaatttgtattacttttatttggtaaaatgtctgtttttgatgcacttaccacctcatttggtacagccggaaccggtgggtttggcattaaaaatgacagtatagcgggttactcgccttatattcaatatgtagttacgatatttatgattttatttggaattaatttcagtgcttatttcctgcttttaagcaagaaactcagacaggcaatccatatggaagaagtacgctggtatctgattatcatctttgcttccattgtctttatttcttttaatgcaagagcaatgttttctactttagaagaaaccataagacatgtctcatttcaggtagcttcggttattacgacaactggttttgctacaacggactttgatttgtggccggaattttcacgtacgattctggttattttaatgtttattggcgcttgtgccggaagtaccggtggtggaatcaaggtttccagatttattttattaatcaagaccatgaaaaaagaacttcacacttacctgcatccaagaagtgtaagaaaaattcagatggatggcaaagtggtagaacacaatgtccttcgttctacgaatgtttatatgattgcctatattctgatttttgtggcctcggttttactaatcagccttgataactttgaccttaccacaaactttacagcagtttctgcaaccttaaataatatcggtccggggcttgaactggttggaccgacccagaactttagcctcttttccaatggaagcaagctgattttgatttttgatatgcttgcgggacgtctggaattgttcccacttttacttttatttgtaagagattcctggagaagattttaaccgaatgaaagaagtctccccccactgagataccaaaaagagcagatgtccatcacttctgatgaacatctgctctttttaatatcaatataatctttgttcctctttccggctcactgtcaatttcaatccttgcatcatggagaattgccccatgttttacaatcgaaagtccaagtcctgtgcctccggtcttttttgaatgactcttatctacacgatagaaccgctcaaaaatacgctcctgttcttcttttttaattccaattccattatcttcaatagaaatttgcacctgattttgattcttcttaacctttacttttacataaccaccttcatgattatatttaatcgcattatctgccacattatacatcatttcatataagatatggcgcactccatttaccattatctgtttttctgcttccacagacagcttaatctttcgtttttctgcttccacaagcaaagtcgtgccgatttcttctgccagttcactgacatctaccaattcaaacggcatgctgattccctcatccaattttgaaatctcaataatgtcctgtaccagattcgtcagtctgcttgcctcttcatagattcgtccggcaaaatcaggcactttatccggcggaaccatgttatttttcataatctccgcataaccggaaattgacattaacggtgtttttaattcatgagaaacatttgctgaaaattctttgcgaacttcttctgctttttttagttcttccaactgttgtttcaactgatgattctggtcgtcaattcttaccagcagtggtctcagttcttcatatgctacactggaaagtggttcttctaaatccaactggttaatcggtttaattaattttgaagtctgtttttcaactaataagaaggcaaatgccaaaattacaatcagcaggattcccatcaaaaaaagtccggaaaacatggcttgaaatacactgtctgtcgtttttgccacacgcaccagccgtccatcatctaatctcagggcataataaaaggtcttttttgataaagtttccgagaaacgaacggtttctccttccccttcttccatcgcctgttttacttccggacggtccttatgatttcccattgttgcagaatcttcttccgaatcatactgaacagttccgtcttcatttaatatggtaattctgctggttgtaagtgttcctgcctgttcttcccatccactgtctgtcgtctgctctaaaagcagacggacgtactgcgcttcatttcgtacgtcctgttccatccattcatttgtttttacatacatgatgacgcttgctgacacgaaggtcagcaccatcgagagaataatcataaaccctacataatttaagattctttttctcattttctgtctccaattcgatatcctacccctcggatagtctcaatcaatgctcctgattcttcgagtttttgtctcaatgtccgaatgtgtacatctactgttcgagtttctccatcaaaatcatacccccagatatgttccagcagtttatcacgagttaacacaattccctgattttccatcagataacggagcatttcaaattctttgtatgtcagctccacctgacgttctccatctaatacccggtggcgttccacatcaattgaaagatttccacagcttaaaagtgtatctttcatctgttttttgctccttctaagcactgcttttactctggagataaactccatcattccaaatggctttgtaatataatcgtctgctccactatcgagtccacgcactttatcatactctgcttctttcgcagtcaccataatcaccggaatatctctggtcttcggatctttttttaacttttcaagaatgctgtatccatcctgacccggaagcatgatatccagcagaatcaaatccggcaattctttttccagacatcggaataattcttttccttcctgaatccctattgcttcaaatcctgttgtttctaatgtatatactaacaactcacgaatatttctttcatcttctacacaataaatcatacttccacctcttctggtttttctctaccagaaaagtatacttaattttttacggaaatacaagatgggagcgcatagcgtgcccgtgcaactcgggtaacactttgaaattctacactgcttttcttcattttttccaggtatcggtgtgtatcaaaggcatcctcctgtacctgacagatacagactgccacattcgaacaatggtctgccactctctcaagacttgctgtaatatctgaaagtacaaacccctgctcaatcgtacagtttccatttctaagacgtctgacatgacggttctttaattcaatctttaattcgtcaatgacttcttcaatcggctctacgcttcttgcaatactttcatcttttgtttcaaatccttttacggcagcctcaaccacatcttctactgcttttgtaattacttttaactccgcaagtgcttcatccgagaattttagatttttctcatacagctcttttgccgagcgcatgatgctgactgcatggtcggaaattcgttcgaaatcaccgatgcagtgtaacatgatcgataagtcatggctatcctttacatttaaatctttctgactcaattttaccagataagttccaagtccatcctcatagcggtccacctgctcttcttccgctaaaacctgttctgctttttccgaatcataatgttcgataagcccaattgctgtattgattgcatcttttactttatttgccatttcaactgcaactcttcgactttgttctactgctaaagccggtttatctaagaaacggctgtccaaaagttccattccggttgcttctgtttctttcttatcttcctctttgtcacgaatcgtaagaattgcaagtttttcaagtacttttgaaaatggaagtaacaaaagggttgcaaatatattaaaagtcgtatgcacaactgcgattcctgctgcatttgctgcctgattcataaacggaaactgtacaactgcattgattgcataaaacagtaccataaagacaactgttccaataatattaaaataaagatgtaccattgctgcacgttttgcatttttctttgcaccaattgcagataataatgcagtaatacaagtaccaatgttctgacccatgataatcggaatggccgcactgtaaccgactgctcccgttacgcaaagtgcctgtaaaattccgacagatgcagaagaactctgaatcactgcggttaaaatcatacctgccagaagacctaaaatcggattggaaaattttgttaaaattccggtaaattccggtacatcagcaagtggttttactgcgccgctcatactttccataccaaacattaatactgcaaatccaatgaaaatcgttccaatatcttttttcttttcactttttgcaaacattaaaaatgcaacaccaattaatgccagtaccggtgagaatgtagtcggcttaaataactggataaaaaagttatcactctgaataccagataagcttaaaatccaggaggtaatcgtagtaccgatatttgctcccatgataacgcctactgcctgagataatttcataattccagagtttacaaaacctacaaccataactgttgtagccgatgacgattggataactgcggttaccgcagctcctaaaccaactgccttaagtggattcgaggtaagtgtctctaagattttttccatcttaccgcccgaaaccttttccagaccgtcccccatcacattcattccatataaaaacagggcaagtcctccaagtaaagtcaaaatactaaagaaatccataatttccttcctttctctttcatttgaccttattctatctatcttatgttaaattctttcgagacaaatgtaaaatctatgtaaaataataatagatgaagccatcgcacaaaagtaccctgacttcatctattgtttaaattgcctgaatgagttctgtaatcaattccttaaatcttacagacactttgtcagcagtctcctgtacttctttatgagaaagagcctgtttgctcatccctgctgccaaatttgtaatgcaggaaattccgcatacttccattccaagatgccttgctgccattgcttcacatgctgtactcattccagccgcatctgctccccagcttcttgccatccggatttccgccggtgtctcataattcggtccggtaaactgcacataaaccccttcctgaatcggaatctccagcttcttagcacaaaagattgctatttcacgcatcctttcgctgtatacttcactcatatccggaaaacgcggtcctaattcttctatattctctccaatcaacggacttggaactgctgttgtgatatggtcttttaaaagcataaaatcacctgggcggtaatcaaaattaattccccccgctgcattcgtgagaatcagcttctttgctcctaaaagtcccatcagacgaatgggcaaaaccacatcactcatcggatatccttcatagtaatgcactcttccctgcatgatgacaaccggaacgcttccaatatagccaaatacaaatcttcccttgtgtccggctactgtagataccggaaatccctcaaggtctttgtaatccacagtttctttcacttcaatgtgttctgcataatctccaagtcccgagccaagcaccagtgccacttccggtttaaaatctgtttttttcttcagactttccagacacgcaaataatttttcctttacctgatccatagattgccctccaatcatattatctaccctaaaaactacgaattgcgtcctctccatccgcttcctgaatcgagcgaatttctaccggataactcacagaatcattgacctgtactaaaacagtctccccggctttatgtccaaggattgcttttccaagcggagattctatgctgattcggttatccagagaatttccacgaatcgatgttaccaatttataagtctctgtctcatcatcctccgggaaatagatttctaccaaatcatttaatcctgcttcgtctttttttgttgtatctgttacaatctttgcagtttttaacattctttccaaatatcgaatacggctctcatttttattcttatctttttttgccgcataatactcaaagttttcgcttaaatccccttgtgctcttgcttcttttactgcctcaattgcatttttacgcacgactaattttcggtagtcaatttcttcctgtattttttttacatcactttccgtcaattgttcctgcataatcttcacctcttctatgatatcttagaatccacctgtgccagaaatcctctgcgtgccagttctgcttcaatatcatctaatgtgctttcactgtccgctaagattgtatgataatgatatcccgaagtaatatttttaagcgggcttgactgcccactttcaatttttgccacaaaatcgccaatcttctttcttgaatcaagtccaagttctgcagacagacaaccataaatcttatgattgataaatacatccgctacttttccgccacaatctacaatcagattcagctcctcctgaatttctttatccgtatggcagacataaatgacacgtgacgcaaacaccggtgtctgcagcacatatcctctatgtgttgaaagaatatcctgattttgtgcacgtaaaagtgcaacatcctgtacaattacctgacggctgacgtcaaattgttttgccagttccgtgccggaaacgggcttgggactctgcccgataaattttaagatttcttttcttctttcttcaccgttcatccttcacctcttccttcctgttacgtcttgcaacagaactctattgatttacaggatgaagatttttcatggaaatgtcaagtatcggtgcagaatgtgttaatgctccgcttgaaatataatccactccgacagaaaccagtcttgacacattttcttttgtgacattaccggaacactctgtctgtgctcgtccgtcgataattttgattgcctctctcatttcatccggtgtcatattatctaacatgataatgtctgcacctgcttccactgcttcttttaccatttcaagattttctacttcgatttcaattttacggacaaacggagcatattctttcgccatctcaattgcttttgcaacacttccggctgctccgatatggttatcttttaataaaataccatcggataagttatatctgtgattacatccaccgcctactttgaccgcatatttttcaaatacacgcatatttggtgtcgtctttctggtatcaagcagtctggtcttactaccttctaacaaatcgacaatgcttcttgtataagttgcaattccactcatacgctgtaagtaatttaacgcaactctctctccggaaagcagaacgcgaatatctccacgaaccacacccatcagctgtttattttttacgacatcaccgtcttttacataaaattcaacttcagttttttcatctaataattcaaatactcttttataaacttcaagacctgcaatgacaccgtcctgtttacagattaactgaacttctccagggcaggcttctctcatcactgcatttgttgtaatgtcctcacttgtgatatcttcttttaatgcctccataatcaaatggtctgcatttaatttcattgtaatctggttcatactgcttcttcccttaccctttcaatttcttttcttacgctttctgcatataatttctgaagttcttcttttcctaagaatttcgttgcgtctgcttttttaagcagtgcattttgtacattttcttcttcggcagtttcttttgtttctaaaatctttgtaatctgtcctgcggcacgttttgcaaataccagactttctaataaagagttacttgccagacgatttgctccgtgaactccattacagcttgtctcaccggatgcatacagacatttcatggttgtgcggctgtatttatctacttttactccacccatgaaataatgctgtgccggaacaaccggaatacattcttttgtcacatcaaagccttcttccagacatttctgataaatattcggaaaatgtgttttaatctgtgcttctccgagtggacgcatatcaagccatacataaggtttatggtcaatctccatctgttttcttatctcagctgtcatcaagtcccttggcagaacttcatttgcaaaacgttccatttttgcattgtataattttgctccctctccacgcacggattcagaaattaaaaatcttcttcctggttttggagaatacaaagtcgtcggatgaatctgaacataatccggatgttccagttcaattccatgttttaaggcaattgccaatgcatctccggttaaatgtgggaagttcgtagaatgttcatataatcctccgattccaccacaagcccatacaaccgctcttgcagtcactgcaaacaatgttttgtccgcgcttcttgccacgattccatagcactggtttttctcttccagtatatcaatcattgtggtctgtgtcaaaagttctacattagaaagtttctgtacacaggcaagcagcttacttgtaatttcttttcctgtcacatcctgatgatataaaattcttgatttagaatgtgcgccttctcttgtataagccagctctccgttttcttttttatggaattctactccgcagtcgatcagttcgttaatcacttctcttgaagaacgaatcataatatccacggattctctgcggttttcataatgaccggctttcaacgtatcttccataaaagaatcataatcctcttcatttcgctccacacagattccgccctgtgctaaaaaagaatcactgttttcaagttcatctttcgtaatcataagaatttttttgtcttttggtaaatgtaaagcggcaaataatcctgacacgcccgttcctacaattaccacatctgcttttacgtgtttcatttatttccttctcctatcccttcacattaaaattgctcagtttttgaaattatacatcttttctttacatctgacaagacagatgtaaacttgtactaaaacaagtacaaaaaaagaatcccagccaagggattctcttgtcttttttatttctgaagttttttctttcccaaccgtacttcttccatcaaatctgccatttcttcatctaaatggtcaaacagataatttttctctttcgatgtctttttttgcactttctttgaaatctctgcttctactgcttctacttcttctaaaagatttgcagcagaaagccggtttccaccctgccctaagataatcacctgttctaaggcatccgaagtggcaactgtaacctgatattttctgccaatttcatgtactgttttttcaatatactggtcggcggtttctgcttctttggtatagaccacataaatattgtggtatttcattacacttcctggattgcctttcactttataagcatcaaagaccagaatcaaagtcatttttttatacccctgataattacttaaacggtccatcagcttatttcttgcactttcaatattgatttttgaaagttcatttagatcttcccatgcaaatataatattataaccatccacaagcagatattcttttatcggttctcgttttttctcttttctggtattttctgtctcactgcttctgacacttggatttctgtttggatttctttttgaaacccgctcccagccctgtcgttctctttttactgcaccataagtacgctcaaagatggctcttagttcttcttcattttgaactccttcttttagataagcttctgcttcctggggggttctttttggcattggaatttcttcttctacctgtttttgcatcggggtctgaagttccagatgcatatagtcttctacttcataccacggcacaataaatcctgccccatgtgcacaaaagacagaaccggttggattttccaaatcactttcggaatcgtagttcatctcttcaatcacttcatccgcattatggcacggcatatagcctttcaaggtacaaaacagtctgccgtgcccacttgtataagccatcacttctttttgataatcgcgcatcaaagaaaccggtgcaaaaccagtcactacggaatattctccttcgctgtctgaaagctgaaattccccatacattttctggatatccgccatcgctcttcccactttatctgccggcagctccagtcggaattcatagaccggctctaataaaacactctttgctttttttagtccctgacgcagagcacgatacgttgcttgtctgaaatccccaccctcggtatgttttaaatgtgcccgcccgcttaccagcgtaaccttcatatctgtaatttccgaaccggttaaaactcctttatgcattcgttcttctaagtgcgtcatcaccagcctctgccagttcctgtctaataaatcttcactgcagtctgcaaagaaatgaagtcctgtgcctctttccgccggttctaattttaaatgtacctcggcataatgacgaagcggttcaaaatgtccgactccctcgacgcaatcttcaatcgtctctttatagacgatttttccactaccaaactccacttctgtctgatagcgttcccaaatcatgcgctttaagatttcaatctgtacttcacccataacctgtgcatggatttcctgtaatctctcatcccacacaatatgaagctgcggttcttcttcttccagttcttttagtttgattaacatactgtgcacattacagtcttccggcagttcgattttataggttaagaccggctctaaaaccggtaagaacgtatgggcttcgattccaagcccctgtccgcagtaagtatgggaaagtcccgccaccgcacagacacttccggctttggcttcttttactgcctcaaaagaatttccggaataaatccgaatctgttctgctttttcttcccagagttcttcttttccctctcctgcttctttttcatttgataacagcatttttacttttaaacttccgccggttatttttaaataagttaatcggtttccctgtgcatctcttgcaatcttaaagacccttgcaccaaattcttcaggataggcacatttttttgtaaaagtttcgattccttttaaaaattcttcgacaccctgaatctttaaagccgaaccaaaataacaaggaaagacttttctctttgctattaagtttatgatttcttctttctggatttctccgctttccagataatgttccaatactgcctcatcacagactgcaagattttcctttgcctcttctgtttcaagtccggcactgaaattaatgcatttctcatctaatcgttttgtcagttcttccatcagtgcattttcattggtatccggctgatccattttattgataaataaaaagaccggtatctcatactgttttaaaaggcgccataaggtctgtacatgtccctgtactccatctgctccactgataaccaaaatggcataatccaatacctgaagggttcgttccatctcagccgaaaaatccacatgtcccggagtatcaagcagggtaacctcccgctctcctaatctaaattccgcctgtttggaaaaaatagtaattccacgctccctctctaattcataagtatccaaaaatgcatcctgatgatccacacgccccagtttccgaatgctgcctgtcagatacaaaatgctttctgcaagcgttgtttttccggcatcgacatgtgccagaatcccgattgtcagtttgtttgtattctctaaatccatctatattataaacctacactttctgcatttgacttttttgtattatatcaaaaagaacgtgaaaaagcaaagcagggacaaaagccctttgataagcttctgcccctattttttgtttcattagtcaagcggatattcgcaatccgctttcgctacttgctcataaccaaatagctgctacgcagcttatcagaaggggcttgccccctcctgatacaagcaagtccccacccctgcttattgctttttgcaattaaagcaggggacttccttgatttggttaaatccttttaaaagagttttatttgctcttttttgttttgctccaaactccggagttatctaagtaataatcgccaacccatacattactcttcatagaaccatcctgttctcctccaaagtaataccatttgccgttgattttctgccagcctgttttcattgcgccatcgtttgcgcttccaaggtaataccatttaccccagattttctgccagccagtcttcattgctccgtcatctgcaccaccaaagaagtaccatttaccgttaatctgctgccagtaagttttcatggaaccatcttcagcagagccaagataataccatttaccgtaaacctgctgccatcctgtcttcattgcgccatcgttttcacttccgagataataccatttaccccagattttctgccagccggtcttcattgcgccatctgatgcatttccgaggaaataccatttgccccagattttctgccagtaagttctcatgacaccatcgtttccaaagaaataccatttaccgttaatctgctgccagtaagtcttcattgctccgtcgttttcctctccgaagtaatatttcttaccgtcgatttcctgccatcctgttttctttgtaccgtcttcgccataatagtatttctgaccattgattacctgccatcctgtcttggacagtaatgcctccattgctttttgcaggttttcttctgcagcttcgatttctgcctgtgttgcatcgtctaaatcaagcactgcttttgcagcttctaatgcctgttcaaaattatcccaggtagatgccacatagtcgtctttgtttaattcttctgctttctctactaatgctttgagttcttcaacagatggtttttcttctccaccatctactttttcaagctgtgtcattgcactttccagtccgcttactgcttcgtctacttcttcctgtgttgcagtttcatttcctgctacgctctgtgctttttcgagtgcttctgcaaaaattctccaggtttcctctgtgtagtctgctcttgttaatgcttctgctttttcaagtgcagattccagtttgctcttatctgccggattttccggttcggttggttttgcaaccagatttgccattgccgcatttaataatgcagtctggttatctacttcttcctgtgctgcattttcatctgcataaacttcttttgcagattttaatacacgttcaaagctttcaaaactttcttctgtgtaatcctcttttacttttttgtctgcctcttcaattgctgcctgtaatgcacctttgtttacttcctgtttttcaacaagattctgcattgcttctgcaagtgcagtttttactgcatcgacttctgcctgtgttgcattttcattttctgctgctttttcagctgtttctaatgcagttttgaatgtttcaaagctttctgttgtatagtctgcttcattcttttcttttgcacgttcgattaatgcatttaattctgtcttgtctgctttttcttttaatgcttccatagcagtttcaagtgcagctactgccgcatcgacttctgcctgcgttgcatcttcttttgcgtaaacttcttttgctgcatcaaatgcttctttaaatgcgttccagctctcttctgtatacgcactttcttctttctgttctgcaagaaccaaagctgcggataatgcttctttatttacagtctccggttcttctacagcataaacaccgtttactttccattcgatgataccggttcctcttgaagcatcttctgttgcgccttcacgaagctgtggtgctacagtcaggcgtactgctgttgttttaagctttccaagtgcaatggtattgtatttatctgctgcacactctaagttctgtgcatctgcaacttttacccagttaccattttcatctaaatattctacgcctgcggactgtggcaggaagttcccaccgccatcctggaagtaatacacatccatgctttcgatttcaactgctttttcccatgtgtaggaaacccatccatctataacacttccgtcttctgcatagcgattatgccagttgtgccatacaccatttgaggtatctgcggaatttgccggttctttttcgttatttaagcttgcaagaccaccaagatcatcaattctgccgtctaaaccgtcatagttgcaaagtccgtctgtttttgcatctggtgcaagattttttacctctgtatccggtttggataattcaaggtttgccattgcttctttcagattggaaagtgcttcttcaatctgttcttttgttgctatttctgattctgctacttcttttgctgtatctaacgctgtcttaaatgcgttccaggactcttctgtataaacttcctgctgtttggtttccgcttcttgaatcatttctgttaaagcagtcttgtctggagtttctgtaacttcttccagattgttctgtgctttaatcagggctgaaagtgcagtttctgcttctttcttacttgcctgtgcatcagcttcaattgcttttgcgtttgcgagtgcttttgtaaatgcagtccagctttcttctgtataagagcctgcttctaatttttcagcttctttgattgcctctgtcagctcgctcttatcaacaggcgctaacgtaccatatactttccactctacaacgcctacacctgtattatcttctgcctgtttatttaaggtgacacgaagagcagttgttgttacttcatcaaatgttgttgcattaaatttgtcaatttctaagctgtaagcacttgcatttggaatttctttccagcttccatctgcatccagatattcatatacatacgaagtcggaagattgattccaccgttatcggtttctgaaccatcataccagaagtaaatatcactgccttttaaggttacttctgaaccccaggtataagtaagagtttcgtatttacttgtgttgccccatgttccgtatcttgcgattcccggattataagatttttccggaacaagaccatcgttgataccagaaagtttttcccagccggatacaaagcttgtagaagcagttgcgctaaatgcaaggtttccatcttttgccggaagagaagcaatgactctttcgagttttgctgctgctgcatctacttcatcctgtgttgcttctttgttgtcgtaaactgcctgtgcttcttcgattgctgcacttaaagtagcatctgcaccttcttcaaataaggaagtgtcaacagattttgctttatccagtgcagattttaataactgtttgtctgctgccatttcattcgaatagccataaactttccattcaatgacaccacagcctaatgtttttggtttcatccacatacggattgcagttgttgtaaccggagcaaatgtagtcttgttgtattgattgagtttcactccaaatccgtctccattttctacttctttccagtttccatctgcatcaaggtactgatagcttaccgatgccggtgcaaaatttccatcggtaaagtagtaagcatctgttcctgtaattgttacttcgttattccatgtgtactgaacccatgcatctcctgactgatttcctccctgccagttatgccatactccatgagaagtatctcttgaacttgccggttcataaccatcatttaatccggctacgccacctaaatcctgaggtgtatttacaattgcagttggtgtcgcaatcaaagcaatgttctgctcttttccttctactacctgtactttggtagataccggataatcaattgcttctaatttaccgtttgcttcaaattcaccacgttttgtatataaggatttttcaatgtcatcccatgtgatggattcatatttgcataagccgtttgagtattctacttttgctgtctttggcatatttggtgcaactccaacggaggtaatcaccggtgaaattacaacatttttaattgtagtttctgcttcagaaccatattctttctttaattcttctgcgcttaccgctttagaaagcatcttgaagttatcataggttccgtttaaccacggagaactttcagaactggcacgaccgataaagtttttctgtgtttttccaagtttatcaaaggaaaatcctgcatctttgatttgggcatacgcttctccgttgatatataaaactgcggtattgtcttttaaggttacttctacgttctgccaggaaccagaatttaaaagcacacctgcttttacagtttctgattcatttgtttcaagatttgtcactgtcatggacagttcgtttgcgctttcaaaagatacctggaatacatttccatccatatcgccaaattcaaacagtcttgttccatttgtctgcgtaccgtttaatttcacatccatggaaatggttgcttcttttgtgttctttgtcaagtcactggaaagtttgacataaccaccgatttctccgtccatggaaataccgtttccgccatcttttccttctgcaacttctacatttcctttttgctgtgcatcaataccggaaccgctgatatcttttactttcttatttgcagtgtccatattggcagcttcaaagtcatactgtgcaagtacttccggtaaatcagattccccttctaccgtaacttttacagtatcggatgcactgttactcttgcctttggctgttaattttaaggtgtattcaccagcttttggaaagcttacttttgtggaagttgcttctgtatttgaaaagtttacttctgcttcttccggagactcttctacactccattttacagccggttctgtatgtaaccatgcattgtctcttgcatttccgtgaagcatcactgtttcgtttacagttgttgttgcatcttttcccgcatcaactacaggtgttgtgttttctaataaatctccggctttgatttctacttttgcgctgtctcctgccggaagaggaagagcgactgttgttgtaccttcgcctgcgataaagcttcctgctacttctccatttaccagtacctgataatttcctgccggaatacctgtcaggtctaggttagattcatgttctacaccagttacatttacaatgttcatggaaattgtacttccatcttttgatacggttgcgctgtcatactggtcacgatacagttctaaagaaatcttattattaatcaggtttaatctgtggtaaacaccatctaacggaacaacactgtaagaagcaccattatctttcacttcacagccatatccaaataaaccgaataccgggtcgactgcaacatcagaggaagcgatacgaactgcaccaaaaagcgcaaggtcagcttcaccagacatctgtctccagccattatgaagttttccaccgccggttccaagtgcggtatcatttcccatttctgcctgataagtccaggaaacggttccgatgttttccggatcagcatcaatctgtcctgaattgattacggtaaagttcgcaagttttcctgcataattaattctctgtgcttcacccatttcgtcactgcttaaaccattgttttcaaaacgaagccagtcatccatacaatatcctgcaagagaagcagtatactggaagttgaaccagttttcaccacagattgtggttggatttccataatgataccagattggctgtacaccacggcaggctcttgtttttttattgacttttgacataacggaatcatttccaaacatttttgccagagtgtagattgcttcttcactggtattgtcataaggatattcagaaatatatggatatgggtcatttgcaaagttctggaattttttctccatgatacttgtcaagtttgctgcttcctcttcatatccacgttcctgtaatgcttcaatgatatccggtgtagtagattctcccatcagaccagttgcccagttataaccaacggttccttcattgtataacgcatccataatgttataacaacgaagcagataagtatctgcatcttcgatataatcaattaaatccggatactgtttggcaattttatacatagcaaaataggtattgtagatatgcggatatgcaaatccacggtaagttggtgtattgttcggttcttccattaagaagtcgtgaatcaggtaatcttcctgatgttctcccatcaggttctgccagattgctacatttaaatattcatctaacgcctgtacctgctcttttaccggattgtaggagttcatttctgcaagatattcgccatgaacatatccccagtcatcaccccagccccagtaaccatcaaaagagcctctcttggacttggtatccatcatccagtcatcaaatactttatcctgaatctcacctgctgcatcccactgtgttttcaataaaaaatcagagtgcgtggacaatgctgatttcaaatcatccatcatatagaactgcagcatggttgttttttcttcgccatcctgtttgtagtttacaatgatgtcattttgtcctaaatctccaaaagcaatttcataaatatgatactgctctccattgatttcttttgtttccagatattttgcataagtgttttcgtctgtgcgttcacacgcaagattattggaaacggtatttgtaccttgatgaagattattggtatgcggacagcgatattcaaaagaaatatcctttgcatctacctttgtatgaagatacatttttgccggcatatcttttgcaaatgtcatgcccggaactgcaactgcatcaatgattccctcatcataaagttcggttttcatctcagattcatctgctactcctgtaaaattaaaggaataggttttgctttctccggcttttaaagtcatgctggaactttccatgtaacctttatttccggattttgcatctttactgattgcatcagaatgaatatagaatacattcagaccgtttgcccagtctgcctgatccatacaccattctttttcttctgcacgtctctgtcccacctgccagtggtcctgatattcaaatccggcacctgtttctgtttccggtgtcattagcaggaaatgaccctgaccactcggtcttgttgcatatacataagaggagtcttttccaacaaagctatggtcgactgtgcaggcttcataagcttctccctgattcacccagatttcatgaaatgcaagcggaactccgaaatctccaaataccaaatcagaatcattggtattttctacagtgatatcccattttaactggtcatccactaaagaataggtttctaccagtttaaaatctttaatggcacgagtgccttctgcttttgaattatcataagtcacaataattttgttatcttttaattcaaccgttcttcctgcatcagaagaattggtaagagattcactccaggaatcttcaccatcctttttggtcttgaacatcaaatctccaagccattcatgtgcaccggtgtcctgttttggattatccttcacattcatgacatagtttgtgtcaaattcgtcccccacaattttcaatgacgtgatttctccatatttaccggtctctacgtcaaagtaatcattttttaaatgatatccattttctgtcttctccgcaatcattccatctgttgctgcaagtacatcaatactgcccagatatggaagataatttccaagcaccataatcgtggaaattgcgattgagagaatcgagcgcggtacttgtttcttatccataataattcctccttcttttttcactgcctctttcagatacgcacagccttttttgtatctcttttcgcagtttgtaaaacgttttactattttctttcttagtatactctcatcgaacaatttgttcaatgtttttgtgattatattttacattttggttgttatttctaatttctaatcttattttttataggattttactataaaataacgttttacttatttttcttttcaattcattgacttaaccgaaacttctccctataataaaagaaaaataccaaaaaactacactttactttaggaggtgatttttattgcaacaataaaagaaattgcaaaggcgtgtaatgtctcaatttctaccgtatcaaatattttaaatggaaaaaacaaagccagcgatgaagtgaaaaaactggtcttggaaactgcaaaagaaatgaactatgtgccaaactatatggcaaaaaacttaaaacagaaaaatacaaaaaccattggaattattgccgaggatctcactatcttccatactccatcgattatcgacggcatcagtgaatttatggaagaaagagggtacacactcttaatgggaaatatgcggctttatcagaaatatggtaatcttttttataaagaagaaaactatgactcgcttgtcgaagatgaagtacagcagatgcttgccaaacgggtggaaggaattatttacattgaaggacactaccatgtcatggataatatttccgaactcttctccgttccgcttgttgcagtttatggtcgggtaaaaaatcctgagattacttcgattatttacgatgatgagcaaggcggttatgaagcaacaaaagaactgcttgcaaatggacatagaaaacttgggcttatcaaaggaacagaagcaagctatcatacccttgaaagaaggaaaggatttttaagagcactttatgaatatcagattccgtttaatccatcgtgggaaatctgtggagactggaataggacagacggctatgaaggtgcaaaacgtctggtcaaagaaggcgtgaccggaatctttgccatgaatgacttaatggcagcaggcgtttatgattatgcggtcaagcataatctgacgatcggaaaagacctttccgtcatcggattcgataatcgggaaatctgtgccgcatttacccctgccttatctaccatggcacttcctttaagaaaaatgggaaccattgcggcagattatttaattcaaaaaatcgaacatcccgaaccatctcatcaggatgaatataaaataccatgtgaaatcttaaaaagaaaatcggtatgcagactttagtgctctgcataccgatttttctttttttaccaatacgaattcttatttccacaccgtatctttaattccaatatcggattctttaaacaccggattctttccggcttttttctgttcttcataatttttcagtgctttaattgcagtctttctaagcagcataatcgcaataatattaatgattgccataactcccattgtgatatcggcaatattccaaactacagaaaaatctgcctgtgccccaaagaaaattgctgcaacacaggtaaggcggaaaatatttaataaagctttactgtttttaataaataaaatattggattccgcataataataatttccaaccagactgctaaacgcaaaggcaaagatggagacagtaataaaatggattccccactgtccgatgttggtacggattgcttcctgtacaaatgggattccatctaatactccactttcaccctgtacacccgaaatcaaaagcatcatagctgtagtactgcagattaaaagtgtatcaatgaaaacagaaatcacctgcaccagaccctgtttaaccggatgatcaacatctgcagatgccgctgcatttggcgcactacccataccggcttcatttgaaaacagccctctcttgattccaatcatcaccgcacttccggcaaaccctccggcaaaagaacgggcactaaatgcattttcaaaaatcataccaaatacatgcggaatactgcttatatttgtcagcatggtataaattccaattaagatgtaaacaactgccataaccggaacaataaaagaagtaatcactccgattctatgggcaccgccccagataactgctgcaaatgcaacagccagtatgataccaactatcattggtacatgagtctgcgaataattcggaatataatattctaatgcggaagacatattaaaggactgaagtccgttaaatccataggcaaagcagataatcaatgcaatggaaaacaggattccaagccagcgtttttttaatgctttttccatgtaataagatggtccacctcgaaactgtccgttttcttctaccttataaatctgagccagcgtactctcaataaaagcagacgaactgccaatcactgccataacccacatccagaaaaccgctcccggtcctcctgctgcgattgcagttgcaattccggcaatgtttccggttcctactcttgaagcagtagaaatcatcaatgcctgaaaagaagaaactgatttttctccctcatttccggttttcttttccataatggattttaatccatctttcaataaacgaacctgaactccctttgtaaatacggtaaaaaatacaccagcacccacaagcagaatcagcagaatatacgtgtacatgaaatcgtttattcctgtcaaaatctgattcatacctctctcctttcaaaatgcgtatattctgccattataccgtattttaagtttgtgtcaagtcagtactgtaaagtgaaaatacattcctgcaaaatctctaacttcttctaataattacatattattacttcttctcccactctattagatgcatcagaattaatcatacgcctgacacttacaacatctattttataacctttatttccatacaactcgtttatcaaatctgtattatgatttgtaagcatacaataacatcctctcattgttaattcatcataaagttttgccagtctcttatgactttctatatcaaatccctcttttgtgtaggattcaaacgaagtaggattcaatggcgcataaggactgtccaaaaatacaaaatctccttttcgggcatccctgcaagcatcctcaaaatctccatcaataatagttatcccctgaagatacttagaaatttctataatagaatctccgttaacagaaaccctacggctattattgtacggaacattaaataatccttttccatttacccgatacaaaccattaaaacaatgtttattcagaaaaacgaataatgccgccaattctacatcatattctgatttcattaacttatcattataatgttccctaatggtataataatactgttttccatcttcccacatctcagaatctattttatttacttcacttaaaaactcttttggactatcgcaaattctttgatacgtattaatcaacgctttattaatatcattaattaatgcttttgaaggctgtgtcccaaaaaacacagcgccacctcccacaaacggttcaaaataatgattataattttcaggtattctctcctgaatcttgcttaataactgacgttttccacctgcccatttcacaaaaggtacaatctctgtttttctcattccacttcctcttctctatgtttatatttcttttcaattatacttgcaaatagccaaaagaacaaccacagtctttactccttacttttggaatacaaaaatatattcatggttaatgcccaaaaacagattgctatctatacaaaaaaatgatagattaattattaagaataatctatttttcaaaaataaataccaggaggttttacactatggctacttgtaacaaacaacatcgttatttagaaggatttaatgaacttccagaagctcaggataacagaaacggaggacgacatatctgtgcagcttgtgcttatgaagaaggcttaaaagatgctttaaatggtaatcttcctcaatctgacctttcccatctgcctgatagtcaggctggcactgtacgccataaaagtgcaattgccgcctataaccttggatatcaatatggtaaaaaaatcagtggttaataataatattgttaaatttttaaacttcttttttaaaaaacaaaaacccccgaaagcatagctttcgagggttgatattttctctgatagataaaaattatctcttgctgaactgaaattaacgttttggtaactgggaacgcttgattttactggattcttggaatatggtgttgcaaacacgttacaaacgcaggacttctcattacgcctcaccacacctctaaattatcaaagagggagatgattcaaagtaacaaatgtgcatcttcctctttttttctcgcaatatcattcaacttcgacaatttctaatcaattttgtttaaatattattcgttgctttgttatcattgttgtattcgaaaatatatatgtactcttctgatatatttacttctttctaaaaataatttgcaaatgtgatttcaaaatttttatctaaaaatttctataattgcatgttcaacttgatgttcttttattttatcaatgattatatgcatattttctatttctaattctatttttgtatccccatcctttggtaccataccaaattttcgaaatacaaatccagtaaatgtatcacaatcttttgctgtaaatgtaacacctatagcgtcttcaatatcacttaatcgtatatttcctttcacttcccacttgttatcacttattcttataataacagtttcttcttccgacgatattggttcaatatcatttaaatcgccaacaatttcttctaataaatcaaaaagagtcactattccaaccactccaccatattcatctaatacaatagccatagattgcttcgattgtttcatatttttaaaaagcacatctgcttttgtggtttccataacaaagtatggttcagaaattgcagaatctataaccatatccttacttttttcttttaatctaaaatagtcttttgcatttaaaataccaataacatgatctatcgaatctccacagacgggataaagggtatgtcgtgtattgtggatcgtttcatcccactccttcacatcatcagacatccataatattgtcacatctgttcgatgtgtagcaatcgtaccagccataatatcattaaattcaaaaacattttgaataaactctttttcttgatgatctattgttcctttttcacttcccgcatcaacaagcatacgtatttcttcttcacctacttgatcttccgcttcatttggatcaataccacaaatcttcaagacaatattggttgatattgaaagaaatgaaacgattggcttaaataagatagagattcccgtaaccaatcctgaaattcccattgccagttcttcagattttttcattgcgattctctttggaactaattcgccaaaaaccaacgtgaaatatgataaaatcaatgtaatcaatataacagctatggtatctaaagtagaacgtggaatattcacacccatcccaacaacccaatcaactaaaggttctgagaaattatctgctgcaaaagcacttcctaaaaatcccgacaatgtgattgcaacctgaattgtcgcaagaaatcgtgccggctcttgcgttaatcgtactaatctctttgcccgaccattaccttgttctgccattcgttctagctttgtttcattcattgataaaacagcgatctctgcactcgcaaaaatcgcgtttaatataattaaaataatctgcactactaaaagaataaaaattgatgtactcataaataaaacctttctacaataaaattatctaaatatcacacttacttaaaagcaacaaaaggcatggtctatgttccgaatacatagtccatgccttgcgatatataaataaaaattctattgaattggttcgcttcagaatcattatcactttcgtccatgttaaatattcctcctctcaaatagtattgtagtacagtataacaaaaagacctaacataatcaattcgaaaaaagtaaaaattgtgttaaatttatgtaaaacataaaatccgattatttttaatttctttgggaaattcaattttctttatcatcacttaacatcattttaaagtaaaaagcaagccattttcagacttgctttccaccatatcatcttccttattgataaatcatttctttattcacaatctcccttgcacatgcttgtatatcactcattctccctatccattctaatgtatcatctgcttttagttgttctgtaattccctgtgcctgcttcatctgctctacaatcctttcaaagagttcctgtgcctgttcttttatatcagccagataatcattcaaccttccacttgtaatcagattcaaatatatacctctgcgatattctttcaaataacgtaaatgcctttgtccccatacgcctataaatctctgttcttcttcctccagcaaggtaaaacaggggataagataatccccatgtcggatataagtgccgcccatttcttcaaatattgttttcttcattgtctgttccacctcgtcttatcgttctctatccattgattttttcttaactgactgtttcggctgctgtctgccttcctgctgatagaggtgcagcttttccagtacactctcttttttcggctgttccaacgatttttctttcttctgttccgtctgatttttccatgcccttagttcttcattgtattctataatcagtccttctgctttgttataaaccttctgaaaggcttgcacattgggatagccttcacgttttactatctgttccaaactcttgtgcagacgcttttccaaatcctctaacagttcaattcgcccttccagagattttcgctctttgcctttaaatagtcctcgtaactctgacagttgctttttcaaagaagaaatatcttgctgtgtgcgttttatctctattgactgtctctgcaattcatacatgagcttctgcatatctttccattcctgcaaatcaatctttggtacaggtttaggcggtagtttaaatttgaaaattacttcctgcaaaaagtctttcgcacctcggataatctgactgaacatatccggcagccaaccgtgtgtcttgatagattgcagcgttttgtctgtgattttttcctgctttatcttcaaaatatcttcttcaggaacgccctcaactaatgccacatcaactgtccgattccattcctgccttgccgcattgtccgcctttatctcctctgctttcgaattgttctttcctattttcttggttgccagatatacgccgctctgttggaatacagagagtttttctgattcctcttttacatatcggttgatcgtatcggtaaacagttccttgacttctttggtaaaggctttattcttaaaccattcatcctttttcgtgaagatatggctttcataaacttctccttttgggataatactgcaccccgcccgaagattgccctgctcgtctaaaacctctttctttgtgagtctatgctttccctgctcatcataaaacatatttcgggtagcaacctttacttcgggttgttccaacattttccgttcactaaataccagatgaatatgataattcgtctttgccttgttgtgatgaagggcagcactgcattccacaccgtatcttttatgaaaagtctctgtcttgatttgaagaaagaaaatgtgcatttggaagaacaatattttgatgtaattgacagtaaaacagaaaacggaatccgaaaagttccgattgctgataagctcctgccttactataaagactggtataattcttgtcatgattgcgaatatcttcttcatacagaggatggcaaaagatttctttatcgcaattactatgacagctattggactcctcttgtggaacagattggaattgaccgtacaccacattgtacccgacatacctgcatttccatgttatcggaagctggtgttcaggatacaacaatcaagaaaattgtggggcactccggtgctatgactttgacagaaaaagtttatactcacttagatatgcaggttcttgtagacgcaatcaacaaaaccttagaaaatgaggacagcgtaactgccgatacaaaatctgcatagcaaaaaggacactctccagtgcctatcaccgaaaagtgtcctatattttttagatatttttgttgcaaacgtgttgcaaatgcgttgcgaactgagtaaattccaccgcttttcaccacatctgacaactccacaaacccttgtaaaacaaggatttgaacgtaaattcgagttctgaagattatctcttgctgaactgcggagcgcgacgagctgctttgagaccgtattaaacatctctatggtgcgtttttccttgatattacgggctttttcgcattttctgttgtcggttgtcctattccttaaccatggaaatcggtgatttttcatcgaaattctcctggttcaaagcatcattcactatctcgaaaagttcctctggtttattatacttgaccctcgcgtaaatgtccatagttgtcttactattctcatgccctgccaggtactgaactgtcttagggtcaacgcccgcatagagcagattcgtgatgtaggtatgccgcaacaagtgcggtgttacatcgaaattcagggtatagcgaatcttgggattgttcctctgccttgttcctaatgtcggcttgacggtatatttaatgctctgtccattcacatatttatagtaggttctctcttttgcagaacgaacaactacatactgccaaactctcgtaaactgagaataggaaagcggctgtccttcactgtcggcaatcacatactccgatatggaatttgcttttgcttcccgcagacagcccaccagacacttcggaatgggaatatcccttttagctgcctttgtctttaggacggtggagatcaccggcctgttatgctccgcgcgccatgcccgccgcacagaaatgtatggtgtggattcatccaggaatacacagtcccattgcaatgcaagaatttcttcccgacgcaagccggaatacaaaccaatcataataaaaagatatggcggaagctctttcaccgtatccagcagaattgcaacctgttgatctgttaaggcgtctttctttttcgatgcttttccgccctttgctgaaattcctacacacggattatcggttatcagctgactgcgctctgccgaataaaacacacacttaatcagcatatttaccgtatcatacagtcctttcgatttttgagatagcggaacaagcgccagacgaatatcatccgcagtcacttcctccatatacatatctcccagagagctaatgacataattcttcatattctgtctgtatccttttatagtagccgtagacacctttgctgactgcatcagcagccatttctcacaatactcggcaaccgttggatgctttcggtgaaagatgatctcatccacctgtctccgggcctccaactgcttttcatataattcttcacaggtggtcgcatataagctgacctgctttccatcggcatctgtaattctggttctgtaatacagtgttccttttcttgtaaccgttccgtactctggaacgctttgttttttcttagccatacaaatcttcctttcctgataatgagtgttcttaaattcacaccttctttttatcagaaagcactaacttaatcaaagatacggattatgaaaaacaaagagcgagacatccttgcctcgctcctgcgttgtttcctgcttttataatgttatgcctgtgctgcatcccactgggcaaatgcaccacccattgttcttaccagctcatccggtctgttgtatttgacctttgcgtaaatgtccatcgtaattttactgctctcatgtcccgccaggtattgaaccgttttcgggtctacggacgaatgaatcagattcgtaatgtatgtatgccgcagctggtgcggcgtcacttcaaaatctaagctgtaaatcacttttccgttatgtgctgccttttcaccgaggaccggcgtaaccgtgtgctttacacgctttccatcctcgtagcgataatagaaacgctccttgacagttcgggtcacaatatactgccagagccgcttgaactgcgtataggataacggatcaccgtctctgttcgacactacatattctgactgtgaattagcttttgtctctttcagacagtccgccaggcaaaccggcaacggaatatttcgatgcgcggctttcgttttcagctcatccagaatcaccggtctgttattttccgtgtgccatgccctgcgtaccgttaaataagggcaatccacatccagatatacagaatcccattttagggcaagaatttcttctcgccgcaatcctgcatacagccctaacatgacaaatacatacggcggaagtccctgaatggcatccagcagtctggcggtctgttcatctgtcaatacagctttgtccttttgcggaatgcctccgcctttggccgtaaggtaaatcgttgggttgttatcaataatcttactttcctttgctgcccggaaaatagatttatacaggataaccactgacttatataccgaagcggacttctcagaaacaggaacaagtgcaagctgaatgtcatccagtgtcacatctgccatccgcatctgccccagttcttttataatgtgccgtctgacctttgatgtataatctatcagcgtggttgccctcacatgaaccgactgcatcaaaagccatttttcacagtagtctgcaaccgtcggggatttccggcagaatgtatcgttgtcgatctgctctaatgcacccaactctttatcatataattcttccggtgttctcgcataaagggccaccagttttccatctgcgttctgaacccgcgttctataataatctatgccgttaagcgtaactgtaccgtattgtggaattgctctttttctttttgccaattccgccacctcctaagaatatactccagcgctgtatctatgttttatcaaaccattccgattccggcaaggatacggaccggctcacactccagctctgtgaggtttacgataagttgcgttcttttctgctggctttgctctgtgggtgcattttgcgatatactcctgaaggcccgctgaggtaaagtacacacagccattctgcacatattgcacataagaaataagaccattgttacgggccacgtccagcgttgcaatgctgatacctaaaatttctgctgcttcttttcgtgtaataagtttttccataaagcatatttcctccaatctgtcaagtttgtcatcgtgtttgttcaaagccacatgaatacgctagcagccgaaactgccagcgcatggtatctgattttgaacaggaagctgcaaacacttcctatttatataactcagctttcatcacatttgccacgccccctgacgatgggaacacaacaggtctccgctggcgcggctgtcataactccgcagcaccgttcatatcgtgtgccgcagggttccccccaagtctttggcgggccgtgaggaagtatctttaagcccccatgcagtcatcgcgccgaatctgccacaatccgttttatgaaatcgtagatcgctccgaagaagtcttttcatcacctccctgactgctccatcttcgcggcgtttcatattcgctcgtacatgggttatgtacctgttgtgctgtctattcgattgtcaatgtactgatgaaggaggaaaacttgtccttcttattaacactgacaaaaaaggcaaaaaacaggcgcatcaaatgaaactttatcaaaaatattttacaagctgctttaatccacggcggatactgtctcggacacggcttgggtctacaccttctacttcggcaatttcatttaccgtcattcccagatagtatcgggcataaatcctctttgcctgtttctccggcagcttcatcacagcggcatagacctgctcctgaaactgtttttcctccagaagcatctccggtgtttgcggcttcaatagcaccgcattttcaatgccattctcgcaatccagagaatactgcgctttataacgatacatctttcgctcatacgcagcctccgcacgttcagctgctcgaatagtctccattacttcctctgtcacatctacaaaaaagtctgttgtataaacatcaggataaagttcccgaaggttaattttcttcattatgtacctccatttcgattcacgggtgattgacgggtgaatcgaatggaggcggagaccgacactggcagacaaccgggtcatctccgaaaaaatggcaacaaaaaacgccagatttccgtgagggaaaactgacgcgccaagaacagccattattatactgaattacatggaacgataatgccgatgcaatgttatacttgcccggaggaggagcaatgctttttttaactggtgtagatcatggatactgcaaaaaggcaaaaaggacacggcgatacctcctcggacaccgccgtatccttaaaaaagggcgactttatcacaccccccgcaaatccaatttttcaaaaggaaaacggcggcttgaaatgcaatatttcaaaaccgccattctgcgccgcaaggccgaattcaacggtcttgttatgtctgccaacacagttgctaccaaaaagaaaagagccgataaaccgtttgcctattggctacgggttatcggctctgcgtctgtgcgtctggctcttttacaatcgaaatattcaaattttgtgcggtaataagtgtttcttgcttacacttaggacaatacagaggaaaatttatgagtattgtatctcctctgatttttaagcgtgttttattacggcatacaggacataatacccattgaatttctggcaagcgtttgccctccaatctactttttcttgttcttcttccaaactttatataaagcgttcaagataggaagtaaaacgcatattacaacaaaccattctggaaaatgtggcatattacacctcctcgttctatgctaaatgaaatactcctactacaatgcaaacaactgtaacaaataaggatacaagtattctcgctaatgaatagctatataatctttcaggatgttgcaaatcatagcgaacagtcacagagttacccacttgggctgtcaaggggacttgtatgcgatttcctgaaacataggttttcccatccacccgataggtgacttttgcccactttgaattgcgagtctttgccgtttcgggattgggcgaagtaattgagttgatggttcctgttgttttcccagttatatttctttttgcccaaaaggcaagtgcgttgtaaagagcaaaaagaaaagagactgacgcaattaaatataaaaagatcgtgtcgtttttcattttcgttcacctccaatcaacaaaggcgctatgataagtcagccttacagtacaccttaaccgatattccagcagacaccgccaatacaataactccaatcaaaatagctccggcagacaagatgcttggcgatagagcaattaagggataccaatttgcgccaccctgcattttcagtaattgcggcacaataaaaggagaagccataataatgataaagaacgcaaattttgtcgtttcatatcccaacttatattgtactgggaggtaaataccaaggaacagagccacaacgaggaacataaccgctgacagttcaatgtgaaatccaccgagaacagggaataacaatgtctctgcccagaaaatcaaacagcaagcgccataaatcagcaagccaaaaacatatttagaaagtacaagtagtttgcggggatatggtgtagcacaaagtagtgtggacgcttttgcgtattggttctccttcaatgaaacatactgcaatagcataaaaacagaaaaaattgcagctaagataaagctcatagaaccaacataagttgcgtcgtctattcgccacatcataaacggcggtataaaaacacagaccgctaacataagcaaaacatacttcttcacgataagaaaatcttttctaactagatggattagcattatttttttcctccttcaatacttcccaacataatgtcctcaatcgttggccgttccaccactacatcaggaataagtcgttgcacctcagaaatctttttagtgataccggaaaaaccaaatgccgtttccgtagtgcttaaaaataatttacgggtttctgcatttagataacgcacatccccttttacaatccgatagtagtccagcagagtatctttttcttcctgaaatacgatgtgaccattatcaatcataattagcatatctgcgattttgtccaaatcagatgtaatatgtgtagagaagaaaacaccctttccgccactattcatgtaatcggtaagtatagttaatagctggcttcggatcaaagggtcaaggccgctggtaggttcatccataatcagaagttctgctttatgagacagcgccagtgccaacgcatatttcattttcatgccttttgaaagcgtattgattttctgttttgggtttaggttgaaccgttccagatagtttttgaagtcttgttcacaccacgatgtataggccggagagataatacttttcatttcagctaaagataattcttcataaaaatagccatcatcaagaacaacgccgatgcgatttttaatttcctgctcatgactttgcatatccaatccaaaaaattcaatatgcccagaagttcgattagtaagctctaaaatcgtccgtaaagtggttgtttttcccgcgccgttcaccccaataaatccagtaatgcacccctcaggcaaagaaaagctgacattacttaaagaaaaattaccgtatgatttgttcaaatcggaaactttcaaaattgattccatttcaatcctcctcgtataatatatccatcatagaattaagctcgtctttgctgatattaagtgattttgcagtctgtatcatatccagcattttttgctccacaagccgtcgttttgaatcacggagcaaatcaagattgctggtagaaacaaatgtgccaattcctacctgactggtaacaaagccctcttgctctaattcttcataaacccgcctaatggttaaaacactaaccttcaaatcatttgcaaaggcccgtattgacggtaacgcatcgccctcttttaattcttctttcaaaattgcgtctttgatttgctctttaatctgttcgtaaagaggggaatcagaggcgtttgatattagtatcttcacaagttcattatacctcctgtatggtgtgctgttgctatatacacactatacactataatcactttcctgtcaaccacgcccgaaaggacaataaaatactactaaaacataaaatttagtttcgttctcataatcagacccgaaatgtacaatgatatagggtgatatgagaatgaaccaagatgaaagaaggtttgactttcatgggctcgggctcgctttgaaacaggccagagaggaaaagtgtttttggcaaagctactgcttgaaaaaccagatgtattgctattagatgagccgacaaattttcttgataaagatcatgtttcttcactcaaagatagctttacaaaatacacctctaaggctactacaataggtagggcgcaaggtcttatgcagaagcactttgagaccttgcgccctctgttattctaccctaaaaatactttgccagctgcttcagaccacgccggatgctgtcacggacacggcttggatctacaccttctacttcggcaatttcatttaccgtaattcccagatagtatcgggcataaatcctctttgcctgtttctccggcagcttcatcacagcggcatagacctgctcctgaaactgtttttcctccagaagcatctccggtgtttgcggcttcaatagcaccgcattttcaatgccattcccgcaatccagagaatactgcgctttataacgatacatctttcgctcatacgcagcctccgcacgttcagctgctcgaatagtctccattacttcctctgtcacatctacaaaaaagtctgttgtataaacatcaggataaagttcccgaaggttaattttcttcattatgtacctccatttcgattcacgggtgattgacgggtgaatcgaatggaggcggagaccgacactggcagacaaccgggtcatctccgaaaaaatggcaacaaaaaacgccagatttccgtgagggaaaactgacgcgccaagaacagccattattatactgaattacatggaatgataatgccgatgcaatgttatacttgcccggaggaggagcaatgctttttttaactgatgtagattatgtgagctttgaaaaagcaaacgagacacggcaaaataacctccaatcggctaccgtgtccctgcaagtcgtcataggattgtgtaaacgcaaagaaacggcggctctgaaatcaaagccgccgtttcaaatgggcgtgtcaaattgtctgctctacgacggctttttttcttttgccgtcgtccggcagattttctcttttaaggaaatatttatgaagttctatgatacagcaagatccaataagtctactcactttttattgctgataaaatactcgcttttttcaattccattttggaatacatcgaaaaaacaaggtatatcaccaataatacacaaatcagtgccaacaggaaaaaccacggtaatttcaacgtaatacaatgattgatggcatctaatcgtctgcatacaattacactaaaaatacttccgcatataagagatattgccaatgaacctccgaggtaaattccaatctccctattcagcattgctttcaactgttttcgcgttaccccaacagcttccaacagaccgaattcacgctttctattctgaaaatcaaccataagcatattcataagactgatacttccaaagacgaacagaatagcagaagtcatatatagagcatttatagatgcactgtatcgatgctgaatatttttaatcgtttgttcaatcgtatttacttctattttttcatttttatccgcaatcttctgaactgcggtcaaaacttcatcaaaacatccctctgaatttttaatcgccagaatccccgtctgttccgttatccctgtcagtttctttgctgtgtcataagtcataatgaagtaggggcttccaggaacaaccgggctatcctccattaaatcagatctattgtatgtgcctacaacaacggcttccacatcaaaggttctaccatcaaaagctctgccctcaatcttcaaagtatcgccaacttgtgctatatcttctgcaaccaatattccatttttctcaaccatatcatcgtaatctgctgttccagaggataacgccgcctgcttttcttctgtctgttcccgatttaaggttggaaagaagtctgaaatgctcgtgatagaaccactttcgcccgaaaaagtagctgtcatataaacgctgtcaaatgcggtaatcttttctatcccatctaccttttctaattcctgcatcaatgcctgatcttcaagtggattttcttccagttgcaattttgcacttccgtatggctccgcttcgttatcgaaagagctgccaactgtatttcttatttgtataagaatgttaccggcaggataatatttgaaacttgcctgttttgccggatcaatagaaccagcaaccgtagaagtaaccagtaaaagagctccgcttactccaagcattaaaagcgtcagaactgctttttgtttgtttctttgtatatttattttcgccagattaaacggcgtaagtttccgatgcagttttgagctgctttttgcctttccagcatacgcaaggtatttagcaccctctaccggggaagtattcattgctactcggacaggcttaaaaatggcaatattcactgttacaaaggctactgcggcaatcagtacagcataaataactgttgtttttagccggaatccatcaggacagccaataaatccaatcagtacaccaatgacaagccccaaaggaataccagctaaggcatataaacgtccctctttacttgccatccgtttaatctgtctttttgtcatgccaactgtccgcagttgcccaaacatctgaacattttttacaatctttgtgtaaaaaacaccatagacaatcgttgccgccaaaatagccgtcaacgccgccagtagtggtactggaatcggaatacccgatgttatcacacccgacataacagcagaatactctgtaagcattacctgttcctcgacaatgcctgtattttgtattgctttgccggcaaaattaagaatagccgtggaacttatggcgtctgtattcaaccgcgtatatgctgtaacctgaaaagaatcttttgccaaatcttgggcaagctctttactaacataaataaaatatccgttgctttctttcgtattattcaaaacacctgaaagtgtatattctgctttctgtcctgttccagtcaggtcaatagaaattgtatcgccagtctgataggattttcctaaaaaatcaaggtagttctgggggagcataatctcatccgctttctgcggcacacttccctgaaaagttttttcttcctgatgtaaaaaataatcttcatttccataagcaacagtgattgttttattttcaacataaaacacacctatagcggaatattcgccaacccatgtaatattttcgttttgatgcagctgagccgtttgttcgtctgtaactcccaaaatgccaatctgcgctttattcctctgtgtgttcttgaatttctcttgtgtacctgttgatattaggagaatcgaaaaaaccatacagacagagatggcgattgtcaaaagcagaaatgccttgtttctcttatccgcttgcatactcctacctgccaatttttttacaatggcacttgtatcattttcaaaaggccatgtcatagtctgccacctccttactccacaatcttgccatcctcaatgcggacaatccgatctgcaaggcgggctatgtcgttattgtgggtaatcatcacaacagtctgccggaactccgcacttgtgcgcttgataagccccagcacctcggcgctggtcttgctgtcaaggttgccggtcggctcgtcggccagcacgatagccggtttggtaatcagggcgcgggcaatcgccacacgctgctgctggccgccggaaagattgttaggcatatttttcagtttatcttccagccccagcaggtgaacgatctcgtccaaaaacttctgatccaccgtgtccccgtctaactccaccggcaggacgatgttctcatacacattcaggatgggaacaaggttatagttctggaagataaagccgatgttgcggcggcggaagatggtaagctgctcgtcgttcatttttgacagctctttgtcccggacaatgacattgccggaagtaggggtgtccagcccgcccatcatgtgaagcagggtagacttgccgctgccggaggttcccacaacagccacaaactcgccgtcctccacggagaagttcacgccgtcaagggcgcgggtgatgttcggctctgtgccgtaatactttttcagatcaatcgtctgtaaaacgctcatactcaaaactcctttcaaggctttctgcctgttgataagggtattgtaaaacccaaatgtccgcgaaatgttacagcggccaaaaaatttcattgaaaatcagggtgaaatgttacaacgctcggacatttcaaaaaaatttacggcggcagccggaaatggccgtccgccgcgttctattttgtaggcagcataatggaaaattccgaacccttgcccggctccgaaaccactttgatataaccgccctgtcgcgttacgatctcgcgagccagatataggccaatgcccacgccctgctgttcgtgtacttcttcctcacgatagaagcgccggaagatggcggcctgattgctttcagaaatgcccttgccggtgtcggtcactttgatctccacatacatttcccacagcaccaccaacacagcgattttcccgcctgccggggtgtacttcaccgcattgtccagcaggttaaagagggcttcggatgtccacttgctgtcatgggaaacggtcaaatcctccgggcagtccacggacacggcaatttcctttttctccgctgcatacacgatcccactcatggcctgcgccacagtatcaaagaggcggcccggtttcttgttcaactggatcacgcccgtttccagccgggaggttttcacaagggcctgaaagagaaagtccagcttatccgtctggctgcggattccccggataaagtcggtgcgctccgcctcggtcatgggcttttccagcagggtgtccgtcgccattttcagattgcttaccggcgttttcacttgatgggaaatatccgatacaagggtctgtaactcctgccgttcctcgtccacccggcggcggttctcctgcatgatctggtaaagccttgccagccggtgcccgattctggcaagctgggtttcgctgtcctccgggcgctggggcgcttcatttccagcgatcatgtggtctaaagtctggcacaggtcagcggtaaactgcgatagccgctttccaaaggtctgcgttaatacgaaaatccccacaagggcgcacaacagcagcgccccgcccgtcagcagcaccgcaatctgttttgtcacaagaaacagggctatggtgatcccggacatggagaggacaagccccattgccacccggccaaacagccgctttaccgagaggttttgaaacttcattttgcctcgcctcccgtccattgatagcccatgccgtaaacggtcttgatgtagggggcacctccgtcggattcaatcttgctgcgaatccgactgatggaggttgtcagggtgtgttcgtccacatacttctcgtctatatcccacagcttttccaaaagctgtccacgagtcagcacttgccggggatttttgcgaaacaggttcagcattttgtactccatcggggatagagtcagaggctttccatttaaggaagccgtctgctctgaaaagtccagaaacagccgtccatcgtcgtaaatgtctttagctggtttgtggtgttccagcatggcgaacatggctttgatttttcgctgcaaggctctgagcacaaagggctttgtgatgtaatccaccgcgcccacctcataaccccgtatctggtcgctctcctgatcgttggcggtcaggaaaattatgatggtgtccgggtgctggggctttattagcctgcacagttcaaaaccgttgccgtccggcaggttgacgtccagcagaactaaatcaaactcccgttggcggatggcatcggctgcggttctggcgtttagggcagaagtcacgccatagccatctgcggtcaggttataagtcaacatcttattcaaaaaactgtcgtcctcgacaattaaaatctgcttcatatcctcacttcctttgctttttgcagatagtataacaggcaaatgtccgcgaaatgttacagcggacggattttttcaaaaaaatttccatctatattataagttgatccagttagtgatacaaggatggtattcaggtctttattaaaaaccggcataatcaaacctatcaaccggtataataaggttattcctttgtgcaaatcggcacgatagaatatacttgaggtggatgattatgccgattgatgatttaactgctttagggcagaaaatgagaggggccagaaagaataaagaactgacacaacaggaactttccgatctaagccatgtttctgtaaagcaaattgccaatatcgaaaaagggaaaatgaacccgtcctatttgattttgagagcattggcaaaagtcctgcacatctctttagatacgcttataaatccagatatttctctggaggatgagggtgtcaatcagatgaaaatgctttattccagctgtccgccagaaatgcgtgacaccctgttgcatcacacccaggaaacggtgaaagagctaacagagttgtccgagaaatttgaaatgaattgagccagtgagtgaaatttaacgattctctcactggttcttttcattttcggagaaaagaggcaagcaatgcctgtgttaatacacacaggcccgcagagaagaaaatccctccgtgattttcctctccgcttgcttgttgagggcagcgcccccaagcccctttgaacacagaatttcattctgtggctacgcgttctgcgaacgcttttgaccaggaccagcttaccgctggccgtggtctttttctttttcaacatcctgttctacctccattttcagcacccgatccacattggcctttgccgttaaaagctccctcatttcttcacgggagcgccgatactcggaataagtctttttcttttcttccagcaattttgcgtactctgtctgtaactctttgacctttggcagcttcttgactcccatctcatcaaaggcattcttagcagcctggtggagcagaatttcttcctcatgttcttcccggaatttcttagaataacccgccttgcggtatgccacatagacctcacgggtcttggcataatttacgatgtgagtacgcagaacagcggtctctgccatgcacttttcagccgctttgatctgcgccgaaagatcattgtgatgtgccgtggcagccgtagccttttcttccaaaaccgcatactccagcagattgttctctgacaggtaattcatggtctgcgccatttgtttcagattaaaaactttagcccatcgagcatagccagcaccttttccagcctgcaattttgcctgaatgtccaccagcagattgaccttcggcggctccggctgcacgacagattttttacggggcgtatgctgtttttcaccggccagcaccgcacggatttctgcttcactgtacccggcccccagcttgtcatccatgcgggctacattcttccggccgggagctttgagccggatcgctttcccgcgccgggatacttcacagcccatttccgaaagcagcttcagcagcgcatcaaagtccgctggattctgctccagcgcacggtcaatcatcacccgcagctgctcccgatgggagggcttggcctgatcgcccagccatttgttgtagctttttccgtggggcttgggattctccacaatggacagtccgttctcgatacagatggtatcgctcaagcgccggacggctctggtgctgccccaaaagtttcggaacttccggtcatattctaagctgaccgatgaccagataatgtgattatgaacgtgggctttgtctatatgagtgcagaccacaaaggcatgattgcctttagtaaaacgctttgcaaattctacgcccagccggtttgcttcttccggggtaatctcaccagggcggaaggactggcgcacatgataggcaatcacatcatctgcgccacgcactcgtccagtagcggcaatgtactgccgctttgccagaaggaactccgcatccgcagtccggctgtcacacgcatagccggtaatgagcttgccgttatctgttttctgtggatttgctacatagtcgatgatgtcactgattgcccgactttctgtgcgacccttaccaacatgaagcggcatgattcttgtagttgccataatagaaggccctcctctcataaatattttttcgctgaactctttgcttctatcgttgcaataactttctccgctgggtataataaaaaagaacattctacaacctcaagggagggattttatgatagaacagctcattgccgaagcaacggaatgtgatttcaaagttgctctcgaaacaaaaaagccaaaaagctggttaaaaagtgtcagtgccttttccaatgggatcggcggcactctgtttttcggagtctctgatgaccgggagcctatcggcttgtccgatgttcaaaaggatgctgaagcgatcagccgcttaatcaaagaacgtatcacaccattaccgcagtttatcttaaagccattgcaggaagatggtaaaaacctgttggctctggaggtttctcctggccgcagcaccccatactattacaaggcagacggcgtgatggaggcatacatccgtgttggaaatgaaagcgtaattgcaccggattacattgtgaatgaactgatcttaaagggaaccaatcagtcctttgacaccttaacaacagaagctgtgaaaaaggattacagcttcacactcctggaggcaacctatctggaacgaaccggcctccgcttcgagccatccgattatgtctccttcggtttggctgacaaaaatgggttcttgaccaatgccggaaagctcatgaccgatcagcacacagtttataactcccgtatgttctgtacccggtggaatggcttggaaaaaggctctatctttgatgatgcgctggacgataaggaatacgaggggaatttgatttatttactgaaaagcggcagtgaatttattcgcaataattccaaagtccgttttgtcaaagaagctcagtatcgggtagacaagccggattatgctgaacgagctgtaacagaggctcttgtcaacgctctcatccatcgtgattatattgtgcttggcagcgaagtccacattgatatgtttgatgatcgggtggaaatcacatctccgggcggtatgtttggcggcggctcaattcaggaatacgatatttacagtattcgttcgatgcgacgaaaccctgtgatcgctgacctgttccaccgcatgaagtacatggaacgccgtggaagtggtctgcgcaaaatcgtcagtgaaactgaaaagctgcctggatacacagaggcatataagcccgaattttcctcaacagcgacagatttcagagtcatcttgaaaaatgtaaattaccatcatggtccttctatcatagaaacgacccatgataagacctatgacgcaacccatgatgcaacccatgataaaatccttgcattttgcatagaaccacattcaaaattagaaatcgcagaacactgtggatacaaaaacacaaaaaactttacacaaaaatatctgcgtccgctattgaacaatggaacacttaaaatgacacttcccgataaaccgaaaagtaaacatcaaaaatatattacagttcgttccgaataaacagagaagcagggcagtgggtctcatctcccattgtcctgcttcttttcattccaaattatattcacatcatttacccatacacccaatcctggatcgcaaatttcaaactctgcaccttgctcagcagccagatcgcagccagcggcagccccatcgggctaatcaaaaatgccataaccagcaaaatcacaccattctgcgaggaataggtaatcagcacagccacgccaagcagagcaattaccgtgcttagtagaccaagcaccagaccggatatgtagatcagccccgtgcagagccagacaaaaagcgtcaacaccaaaatgaccggtgcagttacgatcatcagcagacatttcaaaatcttcatttctgttcctccttccaacgctccagatactgtttgcatagggcatccgcttctctctcatcatcttccgtcacttcccgttttcctttggtcagttcaatctccagataagtccggtaatcatcagctaagagatcgaacagttccttgggagtatggcacacctcgccagagcaatagtgaaaatcttggtcaaattcaactcttacacatccatggcggctgatataaacttctatggtctcgtctgcggttaggtaatccgcaaaaatctccagcaccttttcaaaggtcagcatctgttttcactcctttgctacgcttcttattctactcatattatccggtacggacaggcaaaagacaaggatacagacaaaaagaaaaagcggaggaaggtgcggcgaagaaacgccgttcctccctccgcaaatggagtatctacccctgttatgaaagtttggagagttgggtaaggatttccttcacaccctcccacagttgttcctgccgctgggatatatcctccaagtcagcattataaacccgcccggtctcatgcactttgcgggtcagctggttcaagttgttgctgcttcggcgcatcagggagaccagctccttcagctctggcagttccagcttgaccacataaccatccagcgccattttccgcagataagcgctcaaattctctgtcccgtattgctgcatcttttgatggatcagttccagttcttctgcggacacccaaaacaaaaccggcacatcccgcttgcgctttgccatggttatcgctccggctcccgttttttcggggtggcaggcttgcgggcaggcggttcctgcttgagcttttgcaggacagagcttttctgctgttcttgagcgacttttcggaactgtctggtgaacaggtcggtcaaaccgggattgacctgatctaccaccagataggcacagtggcgggaagcgccgctgtcctccagcgtaggaatgctttttgcccatgctttattgtcctgagagatacgcccgtcatggttcttgtgctggatggtgttggcaagaataaactgtacccgttccgtcccgaacttttccagcacatctttgaccgcagcctccgtatccagccgattctctgcatagtgggcgctgatggtctgctcaatggtttctttgcaggcgctgttcgcctgatatgagaggttgtactgtgccatttccccatgctcggacgcataggcagcagaatatggatagaccggtgctgttcgcagttcctctttggctctgcacacatcgtcggcacggctttcaatgctgtcccggatcacacccatatagccggtctccagcttttcaaaatagcggtacacatccgtcaatggagagggagattccaaaagtgcctgagcctgggtgtcggtcaactccagttcctccattgccatcacgatgtcctcgcggatggtgtactcataggcatggtttaagacttcttccgggggctggcttttcagccagtcccggaacttgtcctgttcggcagccatcttttcataaagagctgtattcagatcgttagtattcatgttatcgcacctcctcatgctgttttggtttcttgtctgtactgcggggttgcaccgggcgttttaggttatccagcaccgaaggccgtgtgcttttggcaacaacagactcggtgtgtgcctgcccctttccgtcgatgttgagcagggtatccagctccaccagacgggcgtttttgcttctcagttcttcttcataaaggaatggctttccgacttcctcctttgcggcagcctgctgctgatagaggttatccagctgggcctttgccgcctccagacgctggggcatctgggcgagggcattgtcgatacgggtaagatttccgcgagggtctgtaccaagggttgcccggtgggtcatctgtcctttcagcaggagcgtatactcctgtttccaagcggaaaattccacggacatggcataaccccggtagctgccgatctgcaccggatcggaggttttgacctccttgcaggcatccaaaagggctgcaccggcgttctccttatcggtcagcaggtctccacgaatctccataccagcaaaaccgtcctccgggtgcgggtgagctgtcaagacctccagatcggattcaaagcccttgataaaacccttgtgcttttcaatctcctccgggaagtatttgagcagctggtcctccagacgatattgcttgctctggtggtcggctttcatcagcttcaggcgggatacctccacatccaaatccatacgctccttgatgcggggatctccggcacacagagccttgatctcggcaaaactgagggctgtttcatccacatcatcgcaggaacgcaccggcgatttagaagtcatgatctgactgatgaatttctgcttgttctccactgtctgccagaggtatgcgtcaaaggttccctcggtcacatagcggtacacatgaacaagggggttctggttaccctggcgctcgatacggcccttgcgctgggcaaggtctccgggtctccacggacaatccaggtcatgaagtgccaccagacggtcctgcacattggtgcctgcgcccatctttgcggtgctgcccaaaaggacacgaacctgaccggtacggaccttagagaacagctcctttttccgcacttcggtattggcttcatggataaaagcgatctggtcggcaggcattccctgagcaatgagtttctgacgaatatcgtcatataccgtaaagaccggttcctgctccggcagaggcacagagccttccaatgcgtgaagcagtggattatccagcgttttcgccgccttgcttacaggagcttttgcctgcggtgtagaaatgtcgcagaacaccagttgggtcagcttgtcagctttgccatcccgccagatctgcatgatgttgtccacgcactgattgacctttgtgccaggttcatccggcagcatctggttgacgattctctggtccaggcccagcttacggccatccgaggtaatcttgagcatattgtcctgggacgggtcaacggttccgctgtgtaccagcgatgcgcgctccgaaagggccttgaccatttcctgctgatgttcggtgggctgcgccacgatgttgtggtattccacctccggggtgggcaggttcagttggtcggcagtcttgatgtccgccacttctttgaacaggttcatcagctctggcaggttaaagaacttggaaaaccttgttcttgcccggtagccggttccttccggtgccagctccaatgctgtgacggtctctccaaatcgggaagcccagcagtcgaagtgggtcatgttcagttcttgcaggcgttcatactgaaggtaacgctgcatggtgtaaagctcggtcatggagttgctgaccggtgtgccggtggcaaaaatcacgccacggtttccggtgatctcatccatatagcggcacttggcaaacatatcggaggatttctgcgcgtccgatgtggaaagaccagccacattccgcatttttgtgtatagaaacaggtttttatagttgtgggcctcgtccacaaacaaacggtccacacccagctgctcaaaagtcaccacatcgtcttttcgtccctcggcttgcagcttttccagtctggcttccagagactttctggtacgctccagctgcttgacggtaaaacgctcgccgccactggcctgtacctctgcaatcccctcagtgatctcgtcgatctgttcatagagaagccgttcctgacgctcccggctgatggggatacgctcaaactggctatgtcccatgatgatggcatcataatcacccgtcgcaatacgagcgcagaacttctttcggttatgggtctcaaagtcctttttggtggtgactaagatattggcggaaggatagagacgcagaaactccgacgcccactgctcggtcaggtgatttggaaccacaaagagagatttctggcacaagcccaggcgtttggcttccatcgaagcagctaccatctcaaaagttttgcctgcgcctacttcatgtgccaacagggtatttcctccatacagcacatgggcgatggcgcttttctggtgttcccgcagggtaatggccgggttcatgcccccaaaagtgatatggctgccatcatactcgcggggacgggtagagttcatttcttcgttgtactggcgcaccaaagtctggcggcgctccgggtctctccagatccagtccctaaaggcttcccggatagcttgctgtttttgggcagccagggtggtctccttggcgttcagcacgcggcgctcttttccgtctgcgtcctctatggtgtcgtagatacggacatcccgcaggttcaggctgtcctccaaaatcttgtaggcattggcacggctggttccataggtagtgtaagctgccacatcgttgtaggatacagaagatttccccttgatctgccattcagcagtaaaggaggaatagttgacctcaatgctgcgctggagataaaacggggtgttgaaggtctcgtacataaactgctggatatactccttgtcaatccaggtagcgcccagacgcacctcaatttccgacgcatccaggtctttgggctgggcggcggtaagagcttccacattgactgcataaaccggggcctgctgtgctgcccgctgtgcctgacgcagcttgcggcgcacattcccggacaggtattcgtcggcagtcacataatggggcgatccgtcctgttccagctgtcccggtacacggaagatcacaccttgcagttctccctccagttctgcttttgtttttccgctaagctggctcatatagctcatatccacgcaggctttttccgagatggacaccgccagtgcttcacttgccgtatccaccacagccaccgcctgatggggcttgatggtccgcttggtgaacatatccgccttgcgctccagctttccgtcctcgtcgatgacttccagcgcacagagcaggtaataggaagaatcatctgcataggccagccgatttgcacggtcattgataaggccatattttgcagaaaagctgtcatagaggctgttcagttccgcctgcttttgggtaatggtgctgtctggaaccgctgcatccatctgaaggtcgatcagttcctgcacacaatcacgcagtcccacaagacctttcacacgggcttcggcggtggcgttgaggtcagggcgcaccatgcggctgttttcccgatagaacacctgcccgtctacaatggcataagaatagttcttcacattaggatcggcaggaatggaggtgccaatggcttcgccttcgcccagctccggcagctctgcctcctgataagtgccatgaatatacttcaccgcatcatgcagctggtcggaaagctccagtccctcgatagggttcacggtgtagtccataccatgagcagtgcttaccggctcctgtctgcccagcaccatttccgggtggtcgataaaataccggttgatggcaaatccgtcctccgtctgtccggtctgggtccactctggtgcaatgtccagcgggcggtcccgcttttggagaaagatgatgtccgatacaacctcggcaccggcattctttttgaacgcgtcattaggcagacggatcgctcccagcagctcggtacgctgggcaagatagcggcgcacggtggaatccttggcgtccatggtatatcgagaggtcacaaaagctaccacaccgccgggacgcacctggtcgagtgctttggcaaaaaaatagttatgaatactgaaattcagcttgttgtaggctttgtcattgacctgatactgaccgaacggcacattgccgatggcaaggtcaaagaagtcacgcctgtctgtggtctcaaagccgcctactgtgatgtccgccttgggatagagctgctttgcgatgcgcccggaaaccgggtccagctccacaccgtacaaatggctgtttcgcattttctccggcagcataccaaagaaattgcccacacccatagacggctccagaatatttccggtctcaaatcccatacggtccaccgcttcatagatggcctgaatgaccgtagggctggtgtaatgggcgtttaaggtggagcctctggcggcggcatattcctccgtggtcagcagctctttcagctgggcatactctaaagcccatgccggtttctccgggtcaaaggcatcagagagaccgccccagcccacgtatcgagaaagaacctcctgctgttcggggcttgcctgctgtccggcagcttccagctctttcagcaaacgaatcgcattgacatttgcctggaacttggctttcggaccgccttcgcccaaatgctcatcggtaatgcggaagttttttgcattgcggcgcaggttagccttgtattcctcataagatgcttcctcggcagctttggcattgggaaaggtctgccactggccattgacctgaatggaaaccgggtgttcatccaacacttcctcaaaggttttctccggctcagtcacaggggctggtggctccggctcctcgatatgcagtcgttccaccaccacatcataaggcagattgttcttatcgcccggatagacggccacagtctcggaatggaaggccggggattcggcagccggttggggctgttcctgtccaaaaccgtcctgctgacgggcatacatcccgcgcagcaaaggcgcaacctcatcccagcggaaatacagcatagccagacgcttttcctctgcatccatgacttccagttctatgccctgtgccgtggtacggtaatcggcaatatcgccggtctccagattcagtgtctcgatctcaccggaataggctctgctcagccagtaggcgatctcgctgttgctcctgccggattgcagcagcgtggaaatctgctttttatccgcttcatccatcagtccatgagccaatacataccgcaagtcctgatctgccttgtccgggtcagtaggaagaaactcggtatagtaagcattgcggcggtctgcccgaagcagctgctcgaactgttctttgcgctctgcccggtagatgggatataccatcccggtgggcagaagctgtacggtgtcctcccgcagctcggtgatctgataggcgtcatcctcgatatacacggtatcgcccacggcatagaccggggcagcagggtcataggatgttctttgcggaattgggcggcgaactgcatcatattcctcatcggaaatagcaacttcggaagtctgctctgtctcggcagctgcaatctgctctacatccgacatcacctgttggataaacgagtcattgtccagtttttccgagtctgccacctggccgttgacgatccctctttcctccagggcttcccggatggcgatagggtcgatattgtcaaaacgatcctgttcttcttcggtatagaaccggtcctcctgaataagctgggcaagcctgcgctgtaccttcggccagggcagctgtgtttcctccgggcttccgacacggacaacgaacgggctgttgctgccaccgtattcctgagccagccatacagcggtatctttttcccttgcatggtctttcatataacggacaacagcgtgtttactctcgatattgccgttccatgcacaaagggcagtatcaatatcttcctgagaaagagggcgcagaagttcatggagcttttgataggtttcgtcgatcacttcccggtgcagacgctggcggaactccggtatatcagaataaaggcggatcagttccatatccttagaaccaaggaccgcacggcgcacagcggcattgccctcgatgacagcattttcacggtcagaatgaccgcaggcattgcggtatgctgcatcctcggaaatggcggcagtcaccacaggcttatactgctcaaactgctcccgaagggtaggctttggcgtttcttcctccacctccacctccggctgctgggcttggatggcatcttcttctgccagttccttttcagcttggattttgtcatactgcgcctgtttctgttcggtaagatagcggcctttctgaacaagagaggtaatgcgcttggcaaccttttcccagttcaagtgaacatccgggcagtcctgctttttatagtgcagtcctttcccatcgtgatcttcaccgctgtgtgttgcgccggacagggcatgagagtgtccgccaatgccatactcgtctttaaggaatctcactttttccttatccgtatgattttccatgaagaacgcataaatacggccttttcctccggcaaaactgctgccgccggtcatggcggcgtcgatctcatcctcggtaatgaaatgctggacggttggcacttgggaaaggtccgaagaaaaagtcctgcggggcaggtcaaggtctttcaggttctcccagatttcccttagcctatggtagtgaaagcgcagcagatcacggtcctgctgataggcagtccagaaggtggcgtattcttccttgagtgtctggcggaaagccgggtcattcagctgctccgtcaggcggcgggtctcctccgggaacccattgcctctgatctctgacaggcaggacaaatatccggcttttctggcgtcctcactgagatcgtgatacagatgccagagcttttccgagaggagggagcgttcatagcctgccgcttctgcaagctccacattggaggcaaactgaccactttccaaaagctccccgatacgctctgcggcgctctcccaggaaatgacctgggcagacctgtcataacggacagacttcccatgggaaagatggataccatcctcggcataccatgcgctcacactgccaaggccattgccgccgtggtacagcgttttcagtatctcggaaatctcagcggtggttttctgcttttcaaaggctgcaaccacacgctccctttgacggtctgtattgccgcccaaacgcagcacatggtcgatgtcattttgggcaaaagaaaaagcagaggatgtatgcgctacattctctgcttcatctatgaattggatctgttccgcttcggagaggaacaggtttagagtcagctgttgataagctccgccatcaggatttcctcggcctgagctttgcaggtgttcatcagccccacccacttcatgggatcgctggctttcagttcctcggtggctcccgcttccttcgccagctggggcatcatctgctccagtctgctctgggcggtctcgtcgatctccagaaggtgcgggtacaacttctcgctcagcaacatctggttgtagaggatgggacgatgttccttcaggtaggttttcctcatcctgccgtacttgcccaggggtttctccggctgctggctcaacttcaggtcgggaatcagatagtctccgttctggatataggtcatgggattgttcatcttgtttgctcctttcttggttggcttcgcgctctgcatttcggacggtaacgccgatctgccgcagcacctgctggttgatctggctgaccgctgttcccagcgccccgatggtggacggggtattgaaatcaaagattgccatgaaatcttcgtggtcgaagtagcgttccggctccagtccacagcgggacatcaaagcgtaagtgatgctgacggtggcggctgccttgaactgcactccgatgttatactcatcatattcctccaaaaaggaaccgtcaacgatatagaagaagtcctgctgatgctccgtccagtattcctcggccagttttccggctacctccgtgagctgtccggcaagatcatcaccggaaacatcataggtgcgctccagcatggcctgcacggaatccagatggcgctcctccaactgccacagccagggagtgcgggaatgttcacgggttccggtgtcggaaatatcaaaaacatagcgcaggcggggcctgtccccggaatcgtccaccagagcgattcccttggagccgcgccttacataccggcccatcttttcattccacaaatcgtactccgcacaggcggtagcgtccggacgctgggcgtaaatcatcagctgctcatggaacgggtacttgtaaaggcgggaagcagtggtgagaaaccctgcccattcctgccagctccccgtgagctgcgttgccaccttctccgccatctgtgcatatagttcagctttggttggcatagtgttctgtcctcctttcagttttggagtaaagaggtggggtggcatattgccaccccatccctgcgattatggtgtttactggtcaaaatccggatacaactccagctcggcaaactcggcatcactcatggcctggagcttgcccagtgcgctgtctgtcaactcccgcagctcggtttcctccggggccagctcgccgcgcatctcacgcaggctgtcgatcagtccggtgcggctgccggtattgtaaatgcacatcaggttcatttcctcaaaggtaaagtttcccatatcaaatctccctttccgcactctttttgggtgctgtctttttgtgttctgtcttgggctggcctttcagctgctccatgactgactttttcttttcccgttccttccgatgaacggcatcagccaagtccatcagggaaatgggctgaccgcttcgggcctgctgttccagctctgccacggtcggctcttttgggccattgttgatgataccgtcgatcatgccgtaatcgtcctccagcatcatttccgcatttttcatcgggttttctggcaggaatccgaggatctgggtaaaaccaacactgtcacagtaatgacaggataccttaccgtcctgtctgatcgcaacgatgtcgctgacgctcatggagggactgtgaaagtccacgggcttttccagattgaattgctgatagagtttttccagctgctccggcacagtgccagactccctcagaggagctgtgtaaatgaggtcataattgctgcggtctatggaaatgtcatgggactttaaccaatccagattcataaagcgcacattctgcggatcgtcacgacttacctgatagatggcaaagcaatctctgttctgagagagaaatgcctgttcgcgttcctgctgatgttcctgacgctccatgaccttttcgtggaactgagggcttttctcccattcctcatggtccacaccgaaaagaccgccatgatccatgatttcctgcggatcaaacaccatgctctccgtattgtcctcatgcagcacatagacggtcaaaccggcggcatccagttccagcgcccgttctctggtaacagggagcatcccatcataggagtagccatattcctgcatatccggtgtggatacctgctcatccggcatggggtattcatccagtgcctgctcctgcgcttccggcagctgggaagaagcagtcatctgactggtctctgccagcatttgctgataggccgcttcctgcaagttctcaatcatggacataggagcgtgtctgagcgaagtgctgtccagattgttgtcatcacaaatctggagaactgcatttttgcgggaaagctccggcatatccagctgaccgccatccagctctttcatggacgcggcatcataaagtgtatagtcccatccgctgtcacatgactggatatgaagataggtggcatcgtcgatcagaaacaaagcctcctgctggttggcgtccacccccagcacttccatttccggcatggccgcagccagttcctttaccgctttctgtaccagcggattatcacggtaatagtcgattgcctgaatggtgtccaggtcaatggtctgcccggtcaaaatcggaaacggtccttcatagtcgcttccatctttcagctcaaagccaatgcccttgatcccgttcattcgctctgctggaatctcctgataaatgcggattgcttcctccaaagacaggttatcgtggtattctccgaggtttggaaattccatgcactctgctacatagtaggtcagatcgccggtcggcagcctatcagataccttaattgcgtctgctggctgctctatcggggcggtttccggctctacctttgcatgagggtcgattccgcgctctttgcagatttccttatagtggcactcaatgtcggagatcaaagtgccggaggttttgttgatggtctccaaactgactctcagctctttcagctctttgccctggctccagcttgcaatatagccgaagctgttttctccggtctcgatgccaaaatacttgcagaccgcataggagatgctttcagcctccacttcctccgtgtggcggtttttgattgcctgtttttctgcggttggatcttcctcaactgcaagacgccattcaaactgattttcgtccacataacgccaatccatatcagaagcaaactgttcggcttctttttctgtggcaaaatccaacttgaaatcatgtttggttccaccttcactctcctgcacaaccttccatgacggtagcatttcatattttttagggtcatggagcttgctgtgggcaatctcgtgtactgtggctgaaaccgtctgaacctcactcatgccctgacgaatggcaattttctgatgatcagcagaaaaatagccgtccgtatcagcggccattgcttcaaaagtaatcggcaccggtgcgctgcggcgcagggcctccatgaatgcctcataatttggcacattgccggaaagggatgatgcaagctccggcaaaggtttcccgtcggtctggctcacatcaaagaccttgaccggacgaaacatggggatctcgatttctttttcctctgtgacgatctttccgtctttatccaaaatcggagccttggtatccgggtccagcttctgctcctcgattttcttcttatacggtgtcggggcaatgatggtaatgccatgctctcccttttttacatgacgctcaaactggtctttccacttattgtatccggctaccaatgtggcgtccggcttctgcatatagatgagcatggtgttgtttaccgaatagcggtggaagcgggacatgacggacagatagcgcatatacttttcactctcaaacagttctttgatgccctgctcgatgccatctgtgatttcccttagccgttctcggttggtgggtttgttctcagccatgattttcaatctcctttccaagtgtgtgatttctgctgtgtgttccgcaatccatgccttttgttcttcttcactttcataaagaaaaaggtccagcaggtactctacataggctttcttctggattgcttccacaaagcgggggtgcggttcttcctccggtgtcctgggagaacggtcggcttcccattttttcaacagatagtagtaatcggacagtacgcgataacagcgctgtcgatcctcccgaaacttctgtgcctcggttttttgccggacatatctcctgcggggcggggcctggctgtcatagatcaggccaaagtcctgtgccagtttctccgccgcttcttttggggagaggttaaagagctttgcggtaaagtcgatcacatccccatctgcaccgcaaccaaagcagtggaaccgctggtctaccttcatgctggggttcttatcatcgtgaaagggacagcaggccataccatttcgtttgacctcgatcccataaaacgctgccgcttctctggtgctgaccgactgcttgaccgcttcaaatacattctctgccatgtgcctttaactgccggactttttcacagggggctggtatccggcggctttcgcacgctcactggcagctttgcgacgctcggcgctgtatggctcccggactgatacacaccgcttggggacggtaaagttatgggcgtcctttcgggtgatctggtcggggtgcttttttgccagcagttccagcttctccatcagacggggatcgtgggtatagacctcagccattggttctgcctggttatagaggagaatggtttcccgttccactaaagagagcttcatcggctgcctcctttccgctggtcaaattccagcttgaagttggcatactgtccatcgtcctccaaaaccacagtggcatcgtaggtcttgccggttttctccgaatatagccccgtcacacggacacggccatcgttcagcagcgcagacaccacagctttggtcggctgttttttcttggcagcccaccatttgttgttttcccagattgcaaatttacaagaatcattctgacagaagaagcctttttgcaattctgcaacttcaccgccgcagcgagggcatttgcccaccacctcacggggcggagtgaacaggtactcggttcccttgatgacctgataagtccccaccagatctttcagcatggcactgataccgtctaaaaactcctccggggcaagctgcccgcgctcgatctcgcccaggcggtactcccactcggcagtcagaagcggcgattgcagttgttccggcagcactgtgatcagggaaactgcatcgtgggaagggagaagctgcaccgttttcctgctcttttttcgttccagaaaaccggcagataccagcttttccaaaataccggcacgggtggccggtgtccccagaccttttcgctcggcgtcctccggcatattctcttttccggcagtctccattgcggacaacaaggtatcctccgtaaagtgctgaggtggacttcttttaccttctttgacgattgccgcagaaatcgaaagggtctgtccttcggtcagctccggcagggctttctctgcgccctcttttttcgactctgcatccttcattttggcacggtaagcgtcctccagtgctttccatccgggatgcttcaccgtttttccttttgtggtaaactccccaccggcacacgctgcaatcacaacagtttccgaatagatatggggctgggctacggcgcacatcagacgcagggccaccagctccagcaccgctttttctcccgcaggaagggcagaaaggtctgcatccttgagatttctggtagggattactgcatgatggtcggttactttcttatcgttgatgaccgtatgcggatcacaggtaatggcgatttctttgcaaaacggcatggcgttggcaaccaggttcaccaacaccggcaggctgtctgccatatcgccagtcagatagcggctgtcagtacggggatatgtgcatagcttcttttcatacaggctttgcagatagtccagggtctgctgggctgtaaatccaagcaggcggttggcatctctttgcagagtagtcaggtcatagagggcaggcggcttttcggacttttccttgcactccacctttttgattgtgacatttgcaccctgacaggcttctttcagctgctcagcagcaactttatccgccatgcgctccccggatacggtaagaccgggcagctccagcgccacggtataaaagggaatcggctgaaaggtgtcgatctcagcttctcgctgaacaataagcgccaacgtcggggacatcacgcgcccgatgttgagggttcggtgatacagcacggaaaaaagccttgtcgcattgatccccaccagccagtcggccttggcacggcagagggcagcatcccgaagtccgtcataatccgcaccggggcgcagatttgcaaagccttcccttatggcagagtcctccatcgaagaaatccagagccttttcatcggcttttgacagtctgccagctcatagacgctgcggaagatcagctcaccctcgcgtccggcatcgcaggcatttaccacctccgtcacatccggggcgttcatcagctttttcagaatatcaaactgctttttcttatcctttcccactaccatctgccaatgttccggcaggataggcaggtcatcatatcgccacttggcatacttggggtcatagctgtctgcatctgcaagaccggccagatgacccacgcaccagctgacacgccagccgttaccctccagatacccgtccttacggacggttgcgccgatcaccgccgccaaattctgggcaactgatggtttttcggcaattaccaatttatgttgagccatgatggttcctcctctctttgagccatcgggacatttcccggtgacagatacctacgcagggtcttccataattcccgcaaccatagcaggggtggctgtggggtaaagaaggaggacgggaagtttccttcccgccctccggcctgcgtgtcatcatgcgttcatagggactgtctgtgaaacgggtcatttcacactgtcctcatcatcttcttctgtgctgcccccgtcagcatccggttcttccgactcctcatcctcggtttcccattcctcggaatcttcctcgccataatcataatcgtccagactgtcattgcccttggtcttaggcttgttcttaacgagcttcaagtaggcaaatacgccaccgccaccaagcagagccagcaaaaggactatcgcagccgggttcaatccggcaggcttctccttttccggctccgatgtttctgccggaggttccggtgctttgcccgtacatttactcttatcagttgcgcagaccgggcaggccgtattgactgcccctgcttcacattttgttgaacagctacacacagcagccggctcctctttgacattttcatcttccatcagtgccatcaaatccgcttcatccacctggttcagaaagtgaacagcagtctttttatcctcattagccctgtcgatcaaaatgtaaaaatagttgccagccttggtggtaacggtaatgagctgcttattgccaccaaaatcatccaccagagcggcattgccatctggtgtaagtgccggtgccggttctgtttcttccacaatcacattgctgtcattggtagaatcctctgccggtgccgccggagcctgttctgacccctgtgcgaaagcagggatcgtaaagccaaatgccacaaccattgtcaggcaaagggcggaaagtgttttgcaaattcttttattcttcataagcggtagcctcctgattatttgattccgacagtgctgtatctctgccgtggttcattccaccggaaagcatagcgttcagctgtgctggagtcatgcgtagcgcacgaaccatctgaacgatttccagattctctgcctccgttttctgtgcttccagggtcttgagcttttcctgatattccgcaatcttctcacgggttttctcaatttcctggtcgatacgttcaattttgttttttgccataaccgttcactcctttccacaaagtctgttaccagttcatcagaccatagcctttaatgctttgataattcaggtcataacttttgatcttgcaggcatcgccggaatttccctccacggtataaacgcggctgccatccgtaccgatcacgatacccacatggtctgctgtcccatccaaatcccaatcaaagaaaattgcatctccgggagccagattgttatagcctcttgcaccccattgtccatgagactgaaaccacggaacgccctgccactcgcagcctgcaaagcgcggctcactttttccagcctggttataacaccaggatacaaagcaggcgcaccactccacgcggctgtcaaagccataccagctccaataaggatagccgcccacattgccgacctgacgcttggccaactccaccaactgcggatttccgggacgggttccatttacaaactgtacaccggtcaagtcctcggaattgctcatgtcaggggaaccaccgccaaacaacagcggcttattgcccatggtctgccggtaaacctgatacatttccatctgctccggggtcagtaactccgacgccacagcggaaatgggtttgctggtgagtttcacattcaaaatgtaatactcataggggacttcttctgaggtggtctcgccggtctccgggtcggtggaggtctccgtgcggtagcgaatctccacttcctcagtaagcgtcagctgatactgtgctgcaaacacacgcgccagctctgtctgagcgctctgccgggtgtaaccttgcaagacggcagacagaaatgctgccagctcatgagggtcatggccgatcataccaaggtcatagcgatactcgtcataccctgggtggctgttttcaatgttgtcgatttcctcctgcaactggacttctctggctgcataatctgcctccactgccagcatttccgggtcatccgacggataggtggtgccggagagaacggaaccgatgctctgcgccatcatggagcaggaggacatggtattcatcagcatacaggtaatgaggaacaaaacccctgccatcaggaaacccttcttgtggcgcatgacgaatgcccctgcctgctgtaccttttcttttaccgtccttgcggcttttccggttttggatgcagcctgggcggtatttccggcagtctgaccggcgtgtttggcggcggcatactgctttttgatggcctgcttttgctgccagcgggaaagagggttgctggcaaactggggattttcctgcaaagatttctggtacagaacatttacatttgccttttccagttgacgctctgcctgggctgctttgcggtacggcttcagcttgtggctgcgatagccctcccgcaccagataagcgccagtctccaccgcttcctcggacttatgggcgctttccacgcccacgttgtcctgctctgtttcccggatctctttgtggagcttgcccacgaccagatggacgggagcttccctgactccttgagaaactttggaaggtggctttttcttgtcctcaaaggtcagcttcgaggtcttttttccggtatccgggtcaatgaccgtctgcctgacctttttctttgggatattggcctgcgccttatctgctctggccgcagctttctccgctttacggattggcttttccagtgcagggtcagaccgttcctcatcagtaaagcgcaggcgcggctccttattcaaaccattctcccagcatgagggaggacatcatgtagtgcagctctgcataaatggccattcccacaggatcgttgaacatacagccggacaggtaggcataaaactgtgccaccacatcggacaggatcttcgcttcggttccttccagaaccagacctcccataccttccttggcacggatggtgctccagacctctgccagacggagcagccccacctgaccggtctcattcagttcggctgcttggtctgccgccgtgcggcactcgctgaccgcatcggccataaccgtaagcagctggctgcgctgggcatttaccgccctgtcaaaaaacatcaacgggttttgattcaaaatgctggggttcatcatcattcatcctccttctttttcagttcctggggtttggtggtcataatgcggtacagctcggtattcttcgggaagtggtccacgaaaggcagaattgtggagccatagaacagcaggccctcgccctcaccggagtgagtcacatagctaagctggtgtgtggaaatgcccagctgcttggcaagtatctgacggtctccgcctgcctggttgagcatatacacgaagtcggagttttcaaagatgttctctacctcgcggctgctcaaaaggtctttgacattctgggtaatacctgtcggaataccgccccatttacggaatcgcttccagatttccaccgtataggcggcggtctgctcctccttcaaaagcaggtgcatctcgtcgatgtagtaacgggtggacttgtgggcggcacggttaatggtaacgcggttccacacctgatcctgtaccaccagcataccgattttcttgagctgcttacccagttccttgatgtcatagcagacaatgcggttgttgatgtccacattgctctggtgattgaacacattgagggagccggttacatagatttcaagggccgtagcgatatactgggcttccttttcctcctgttcccgaagcaggttatataggtcctccaaaaccggcatattctccgggcgcgggtcattgaggtaagtctgatagaccaggcgcacacagcggtcaataatggttttctgcaccggctgcaagccctccttaccgcccacgatcagctcacacaagctgaggataaagtcagacttgagggacagcgggctttcatcatccgagtagtccaggttcaggtccatcggattgatgtagttggcagaggtaggcgagatcttgatgacctgcccatgcagacgctcaacaagaggtgcgtactccgcttccgggtcacagataatgacatcatcactggtaagcaaaaagcagttggcgatttctcgttttgcgctgaaggacttaccggaacccggcgtacccaaaatcaagccgttggggtttttcaacagctttcgatccaccatgatgaggttgttggatagagcattgatgccgtagtacagagcttctttgccgttctggaataattcctgtgtggtgaacggtacaaagatagccgtagaactggtggtcagtcctcgctggatctcgatctgattgagtcccaggggcagacaactcatcagcccttcttcctgctggaagtccagcctggtcagctgacagttatacttctgggcaatggagcctgcctggaaaatgttgttgccaagctgacggggattgtccgctgtgttcagcaccagaaaggtcaaaaggaacattctctcgttgcggctctgcaaatcctgcaagagttttttcgcttcactgccgtaggtagcaaggtcggatggaatgatgtccatgtcgtatccggcacgaactgcttttttctgttcctcgatcttactgcggtccaggtcggtaatcttgcgctttaccgtcttaatggctttcacctgatccaccgactgaatgtgcatactcacaatgagcgagctttccatatccaaaaaatcagccagcagacggtcattcagctccggtgcgagaatctgcaaaaaagaaacagccccgtatttcttgcccatacggaactgcttgccggtgcggaactcaaaggaacttggtgcaataaaatcctttgtggacagaccggaaggggccagccagtcccattcaaactgaaacgggagctgttcatccatgtggaataccgcatgaagctgagaaagcctttccttaccgtccagcgttctggcagctacaccaagacgcttgaagttattaagtatatcggtctcaatacgctccagacggggcttggcagctttgatgctgtctgcgtcgataccaaaagtcaggtatttggtcttgatgagaccgttgttacctctggccagctgattttgcagcattgtggtgtattcctcgcggatactgtcaaaggcatccctctggggcgggatggaaatggagttagcaaaggtctcctccgatgccgcaaggttcaaaaaagacagctggaaatgaatcgagctgtcaaaataattgaggaaatcacaccaaccctcaaagattgccgtcttatcttcgttttgggagagctgatagttgatgtcctgaaactggatggtctttgtgtagtggctgtccaatatgcggcagattccgtccggccacatccgttcataagggatactgtcctgcgcagattttccttttttgtccgtgcggttggcacgggcaatggccgcttcgatctgcttcttatcggcgcgggacagctttttctttgtctttaccagctgcaccgttttttcctcggtttttccgaacatccgatgcagccatttttttattgcggtgaacaatgtcatacacctccttatcgagcatttcctgccgctttaatacggcataaaagttattggtctggtagggacgctgcttgggacggatcacagctactttgagaatgttgcccacgatcttttccaggggctgtccatgcttttcgtacatagccagcataaagaagggcagcataaccagcatcatacacatagccgctacactgtttccggtaggttttctgagcaaaaagaaaagcggtacgccaataagcgctccgcccgtaaaacagataagctgccgcttggtcagattgaacatgacctttgttttgacttttgttaagtccttgggtacgggtacataagccaatgtggaaacctccttccgttttaatgcgcctgaaagactgatttggcgagactgccggttttgaacagcgtaaaacatagcagtacggtgtagcccacgcagctccagattgccatgatgatgtcatcttccagagcgatgttctgcaccagcacagcataaattgccacgcagacgataatgagaaacgcctgaaagcccagcgccagcagggatcggaggtaattctgtcccataccgccccattctttacccatcatcgcagccattggaacgggagccaccgaagtcacaaggtagatctcgatcatacggccataaataacgataaagatacagatatacaacgcccacatggtaatgccaataaagagggattggaaccacagtccgaacagcggtcccaaatccatttccatcagcctcggttccaggtcggtcataactgaggaaatgtcaatggacgcatccgaattgataatccctgccgcctgcgccaccacgctctgcgccatatcaaagacgcccatcacgatattccatgtgtttgtgacaatgaggatggcggcagctgatttgaacacccacttgaaaatcatccaggtatccacatcatgcaggttgttcttgtctgcaatcatctggatcaggtctacggtcatcacgatagccaggatcacgcctgcaatcggcaccatgatggagttggacagattctcaatcatattgaaaatactgccattccatccctgtggggtctgtcctacctgtacggatatatccgcgacctgttggtttacgctgtcaaacatccccgaaaggttgctcataataccgcccaccagcatttctttcagccaatttgtcagggcttcaagtaagaaatccatacggtgtcaacctcctttccgccgcccccgcaaagctgcgggagcggcaaggatttcatacggagacgcttagacagagaaaagcccggagagcagaggtacaaggaccatgcctaccacggctacaccagcaccggccatgagctgcttcatgccctgagattttactgatgtgtgataaagaagtaatagaagtgtaaaaaattttgccgttcctatccggcacatgaggtatgtcggataggtcgggcggttattcgggcaagtccaccttgccaacaaaagaataataaatctcaatgtcctgcctacgggtcttgttctcgtcatagctgcactcatgcacaacgattttctctacaaactcccgcaacagagtaggggtaagttcttcaaagctggtatgccgccggacaacattcataaacttttctgcgttcacggtggcttcctgtgctttggaaagctccgcttggatagcagcggctctttctttcagctcccgttgttctgcttcatagtctgccgacagctctgtgaaacgctcgtctgatatgcgcccggtcacgctgtcctcatacagccgcttgaagatagcggataactcggctatgcgtttctcggcggcttccagttcatttttcttagcggcgttcctgcgcttgcccccgtcctcgttctgctcaatcaagagcttcataaaccgagcttcatgctttgccgcatagcttgtcactttccgcagattggagagtacgccagcggtcaagaggtcggtgcggataaagtgcgccgtacagtcatgggtgcgtttcttgtagttgccgcagatataacagtcctgcttgcgcttgtccgtctggtatcgctgctgatacatgacactgccgcagtccgcacagaacagtatgccggagaacaagcccacttcatcatagcggttcggacgcttgcgctgtttgcgtaattcctgcacacgctcccatgtctgggtgtcaatgataggctcatggtggttctcgaaaattgcctgtttctcaatgggattttctacgctgtgtttggtcttgtaggacggtttctccgtcttgaagttcaccagacagcccatgtactcccgattttcaaggatatgcaccacagtatttgtcgcccatttgcattcatagccggggtgatagcggcgtgtgctgcccgtcctgcggtattccagcgtccccggcgtggggatttgctgctctgtgagcatacgggctatcttggtcggaccattcccggcaaggcagaggttgtatatctgcttgactacgggtgcggcttcctcgtcaataatgaaattttcgtcctcgtccatgaggtagccatacacaggcttgcttgtgatgggcttgccactcatgccttttgagcgttttactgctttgattttcttgctcgtatctctcaccagccattcgttaaagatattccgcagcggggcaaagtcattgtcgccctgtgcgctgtccactccgtcattgatagcgatgaagcggacacctttctgtgggaaaatcatttccgtgtacattcccacttgcaggtagtttcgccctaacctcgacatatcctttacgataacggtagccactttcccggcttcaatgtccgcaagcatggattgaaaacccggtctttggaagttcgcaccagaatagccatcgtccgtgtaccagcgcagattggaaaaaccgttctgctttgcgtaggtttcaagaatacgcttctggttggaaatggaattgctttcgccttgcagctcgtcctcatgggatagtcttggataaagggcagtgattttctgggtggtctgtcttaacataaaatcctccgtttccgacagccagccccactattccgtaccttgattgtaccacatggggcggctgtctgtatagcggcaaaagcgtcaaatctgcttctttatggtcggtcaaatcgctgttttttgtgtagcagcttccgcttccagcactttcatcatcttgtcggctgcggtatcggttgcgccctgcttgaagaagccggaaacggtaaggacggagttgcccatgcggatttccgttacacagtccggacggcggtctgttttggtggtgcttgtctgtttcgtttctgtcataggctctcctttcgctgcttcatcagttgctttaatcgttccagcttttcctgtgcggtttcctttcggaaattgctgcccgtgaagcggacgggggcgcacatagaaagcagcctgtcatagatacgggcgtggggcgtgtcctgcgggtgctgcaattcctccagcgtgaggttggtcgtggcgatcagcggcttgccacttcggtaacggctgtcaatcacgctgtaaacctgttccagcccgtattccgtccctcgctccataccaaaatcatcaagtatcagcagggggtagctgcaaaggtgggaaatatactcattcctgccctcaaagctggcggcaaggtcattcagtatcgttgcaaagtttgtcatgcacaccgggacttcctgctccataagggcgttggcgatacaggcggcaaggtagctttttcctgtccccacgcctccccaaaacaggtagccgatattttcagcctgcatggtttcccagctctccacataaaagcgggcggtttcggtctgtgggtttctgccgttgtcatgctcaaatgtccagttccgcatagcggggtcggcaaagccccggcgtttcaagtcctccactgtttcaaggtgcttctgtcggctttcggcggcttgctgcttttcacgggctgcccgctggcagtcgcagtctgttgggtgtcggtcatgccctaaccattgggcggtttcttttgaaaagtaggcttctttgggcgtatggcacttgccgcagtataaaagcccgtcctcgcctgtgtagtcctccgcttcggcggtagtggttgtaatatccgtaatcatagcttcaatctcgtttttcataagctctcgccctccttacatgaataatcgggtatgccctgtttcggggcagccttgcctttggcagcgtcctcctgcgcccacttgtaaatggtggctgcatggctgtggtactgcttcccggtggaagcgatatggcaggaaagccggtcaatataatactcccacttgtcgggcagctctgttttcagcccggaaagctctgtatcggtcagtatcacattgttgtatctgccataagcggcgggggcggggtgtcccgtttctccctctctctctttttctatctctttctctaactctatctctatctctggtggacgaatgtcggacaaatgtccgccttttgtccggggcggtaaaagtgccttgttttccagccttgcagcccgttttctctcggcttcggtagaggactgtcctatcatcagctcaatatcggtcatataaaaagccccgctgtcaagctgctccacaagccccaactgccggaaaatctctaaagccctttcaaccgtccctatctggtggcgggtcagtgtcgctatcatctgcgctgtgtaggggatatgctcgtcaagctgcaacttcccgccgtttttcagagattttaagtacagcttcaagaggatattggaatataaaatcccgtctttcatatcttccagcagcacaatggagtcgctgtcaaaaaaattctctttcagcttgaggtagtaatacttgcggttatctgccattgtccctgtcctcctttttccggcgtttggagtagtagcgggggcaaagtatgataaccgcccggaagctctgcttacagctatgggtacagccccggcagaggtcgttgtatgtgatacggtcgcaggtggtattcccgacttttacttgccgcaggaaaaaagaccattccagccgccgtttcttgctcattcttggcatgggtgcgctcctttctgccgtttccgctggtgtggcggtatcgacggtaattctgtatcatctcggtatcattttcggggtttttctgccctgtaagcccgttaaaaaatcctttggtattgcgggtagagtacggggcagcccccttgttctgtatgggttcgggtacattttggggtggtttttatcgttcctgttcctgccttttcacaggcttgcgctcccggcgtaaaatctggtcgatattgcccttgacagtctgtaagcggcggtattcctcccgttttgcccggtaatcgttgtagccgctgtttttctctttgataaggctttcaatctctgcttgcaaggctttatagcccggcagcttggaaatgccgttctccctgaaataacgggcggctgcgtctgctatgataaagtcgctttcgtgcttctgtcggtaggctgcttttgctttggcgtttttctgctgtttcagcccgtcccggacagggcgggtcttggaataggcaagtacctgccgttgcagctcctttttcctgttcagcgtcttttccacctgcttcagctctgtaaggctttcctgcatggcggcataggcggcagaacaggcttcgtccagttcctccggggaggaaaagccgtactgctggtaggcggtaacggtagccgccatctgctttaggttgtgctttgccgcccagcggtcatagcccacgcccttgccctcggctcgcttggcttcccggtcaaccatgcgctgcaaggtgttgtctgccggggcggtttttgcggttttttcctcctgcaagcgtcccttttgggtatgtgggtattccggtatggctttaggcttttcggcggctctgtgggcgttctgcgtgagcagggcaaggacagcagccttgtcaaaatcgtcccccagcttccgggctgtgataggctttgttctgtccggcgtgaggtaggaaagccgcccccggctctccttgacggtcacgccctcccgcagcaaaagggaagaaaactcgtcaaagctggtagcttgggaaagtgcctgccgtatcgtccggcgcagcttcgccttgtccgtttcaaacttggtgggcttggtcggttgtccggcggcttctctggcggcgttctctttatcaagggcaagctgccctttctttgccgcccagtattcccgttctgttatccgttccttgctgccgttcaagaggtcgatttggtaaagcccctcccggtggcacatctccataacttcactcttgaaatattccatagcggcgttggtacagcggtgcttgcagccctcccgtgtgtcggctggtctgtccatgtagggcagaagcgggacttcataaatccgcagggagttgaggacgatatgcacatggatattcccgctgtggttatgcccgtccgggtgggtgcatacaagggcttggtgtccggggaaatgctctttacagaactgctcgcccagctcctgcgcccggtctacggtcaagccgttgtctgtcccgtcccgtgggtcaaagctgatgatatagtggtggcttttcacatcttcccgtttttggtttttctcatagcggagattggctcgcatacaggcaacggcgaaatcctcgcccccgcagttaagggaagaaatgcggtagtcctccctcggtatcagccgcccgttttcatcaagggtgggcttcatggtaaactcgtcatgctcaaatgtgaggtaggcttccgctgcgccatagtcggcatttttagagctgatatgtttgaatgttgccaacagcatcacccactttctgcaagacttcaaactttagggcagcaaggtcggaaaccgccgcccgtacttccccggcaagctgcgggtagggactgtgccactcgttcagcgtccgggctatctggtttaagttgccgccgatcctgccgtattcggcggtcagcttcccgacagcggcaagcagctcgtcattgacgggggaaacggttatgatggggcgtatggctgccccggttatggcttgccggataaactcggcttggctcatgttgcaggcagaaagcctttccgcaaactcggcgtattcttcctcggtcatgcgtgtcttgactacccggctgcggtgcggcgtgttgtatcgttttcgcatggtaaaaacctcctttcggctgccgcatggctgcggcgggataagcggcgtaagccgcataagcagggtttggggaaggcactccccaacaagattcccgcaggggcaaaatgagcgaaaagcgaattttggtactgcggtagaatcttgctctaagaaaacggcgaaactccccctttactccttactacgcagagaaatgcaaatatggcaaagttttgaaaaactttttgataaaacttttcgacaaagctggaaaatcagcgcggtttttggcgcaaaaaaacaggaaaccttttctgatttcctgtcatggtatgccgctgtaacgggcggcggttattctgttgtcattccccggaagcaaacttgtagcccatacctaaaacggtttttatgtaaatgggcttgcggctgtccggctctatttttttccgcaggttgtaaatcacatttgcaacgcttgactggcagctttcactttccatgttccaaacggcttcaaatatttgtgtccgtgtgaggacaatgccggggttggaagcaagatatacaagggtactgtattcaaggcgggtaaggcttacttcctccccgtcttgaaatacccggcgttggttctgctttatttccagtcccggaaaagataacacggaagcggttgtgatctgcatgggttcaatctgtatataatcagatattgccgatatgattttgtcaatcgctgtttcctcttgttcgttaagtgtcagcagtagtaatttccccatgttcattacctcttttatccgttgaatttaaactatatttttctgtcgtgtttttgacagtaagcaacaaatatatatgatagagagcgtaatgtcaatttaatgccattaaaagagaaagatggtctgtctaattattatcattttgttcatatgcacttacgctgcgtttggcatttaggcaattcaatatattgtaaatttatctatatcagcgggctaacctcattttcacaaaataagctaagtttgtgaagcgctcttgtgcaggcaacatataagaggtttttatcatcttcatcatggtagttttggctatctgcatcacaaattaagacagtatcaaattctaatccctttgacatatatactggtaagataaacacgccttgtaaatctgatacgctcccatttttaattaattgaatatcaagtttgtgtttaattttattaaatagataggttgaatttttttcggttttacaaattaagcatatcgactgaaaccctttctcttggcataattttatttccttaacaatttcatcaatgaagatttcggaattatcagcaatatatacttttgggctatcgccattccgattaaaactttttatctgtgaactttgttcaatgaactttaaactaaaatttaaaatttcattcgtacaacggaaacttttatccaacataataagagaagattttttcttgttcaatattttttgaatttgttcgtagaaagaaatatcttcttttttggcaagagtctgtttcatatctcctaaaatagtaaatttggcattagaaaaaagcaaattaaatatttcatattggagagggtagtagtcctgtgcttcatcaatgactacctgcttaatatttttatatttatttgttccgtatatttttaaatacaaataagcgattgctattgcgtcatcataatacaagctgtctgcttccaaattttccttagtatatttccaaatattttttatgttttgtgacggattgctattttgcagcaggctataaaaataggcttcattgctaaataatattttatataattcaacaatgtcaatttttataaatttctgtatttcctgcttgattagatttttttcttctttatgcccccgcccttttcctgttccaaatatttgttctaaaatataatcttctaattgttctaattttatgcctaatggtgtttctggtcttcctaatatcttgtcttttagaatttgcccgcttacaacgcattttccctcataataaacatcttcaaattctatccactggcggggtatatcaatgagaaattggtctaaaatttccctaaaaaaacttgacgttttaaattctatactatttcttgaaatttccttgtattttgaattgacaatcaagttttctaaaaaatcatttcttgactgaattttcctgccatttaataactcactaagtatatcttcaaacacggaagaaataacattatcttctcccaattcgggcaatacatttgaaatatattgctcaaatatagaatttggggaaataatcataatgttatttgcggacagctttgtttgtaaaccttgatacataagataagcagcccggtggagagcaatagaggtttttccacttcccgctacaccctgtaccattagcaggtcattttccatatctctaataaccacgtcctgttcatgctgaattgtttcaacaatagctttcattttagcagtagtgttttgtgacagtaattgccttaaaaattcatcaacaatctgaacatctgaatcaaaaaaatattccagtattccgttttttatttcatattggcgtttcaaattgagttcacctgttactcgtccacatggagcgtcataaaacgcttcgcctgtcataaaacgatagaaaacactggcaatcggcgatctccaatcataaacatacatctcttgatagctgttttttcgtagagaagaacgtccaatgtatattttttcgaattcgtcctcatcatcaaatttaaaatcaattcgggcaaaatagggcgattttatcatcttttctaacagaagtattttatgttcttcttcttcataatctataattttgtctgtaacaggattgatatattggcttaattcaacaagtgcctcgaaaccgtctgatgtgtacagtgatgtaatgccgtgttctgtattttcacgcacatcttttttggcttcgataatttctgatttctttttgtctgccgcttcttttgcctgctttaattgttcctcggctaaagagattgtttgtgctaatcttttttcttcaaacgctttttctgtctgattattccccataatgattatgacctccttgaaaaatgaaagaaagttttactgaaacattgctaggctagtttagcatgtgtcagcttatataaacagtcttgtatttataaaatttgtatggtattattatagtgggaagaagtatgttagatatttgatttctgcaagcatatcaattctaatacggacgtgtaatttaagcaataaacaaattgggacaaagcagttataccgctatgtcccaatttgctattactccatatcttcagcagacagaaacacaagcccgacaaattcttcctcaatcagtttcttcaacttttccactgtgctctatgcaggctcccgtatctccattccaacctataatctctttctgtaaaagcaaatcttgttctgtgaaaaaatgagttggattccgtagtagtcggcattgtgcgtaatgtgtataactgactgtatcatggaattgtgggtaactctgtttgcaggacgtgggaaagctgcactttagcttttccatgtgctgtgaatagagttatccatgattccatagcctgttatgcacatttccacaatgtttgtcttttggtcgttggttcggaaaagaaaagccctgtatgttattatatacagagccattctaatctttttttatccactacatagagcgtttcctttctgcaaaattcattttacagagtgatacccgccttttttgcaaagtagtcttttctcccggtaagctctgactgtttttcctttggaagattgttgaataaatcatcataaagaacatcagctaactgcatttctctcgcaagcaaaaatacatttagactaagccattcctcccaaagcccctcaaataagctgttactgtctgtataggtgtcaagctcctcaaagccatgtgacgctgtatagcattgcagtttaacaaagccatacctaccaacatcaaccaacaaaatatcttcgtcctctatttcgtacagttcctcaaacacatcaatcactttgcgacacttttcccgttcttcctctgtgatatatactgttttttccatgctcaattacctctatcctttcaaattgtggaatactgttttcagttttcttctacttctgaaccacatatttgaaatgccatatatgccattttatacggaatagaggttggctgtctgcatttatcagtgtgttactttatggcacatgagcattggcgccggggttgtcgttgccgtaaccttccagcaggttgatgacgccccagataccaagaccggcaccgagcgcgataacgagggtctgaagaacggtgattgcctgttcaaaaaatgccatatagtttgttagccggaatctgattaaaaaataggtttgtcatgtttcataggcatacaaaagccggaacaatctgccacccggtttccgggggcatgattccggctgtcctcctttttcattattttttcttgcgattgtccgctttgtacgccaatggcccatagagggcaggtgcggcgaatagataagatcactcccttctaaagcggaacgaaattaagcgccctttgtgtctacttcatatacatcgcagacctcattgggcttgagtttcagccttgcagacaagaatgcttcaatatcaaaagcgttcttgtcatccgcgtcggcagtgtacttgaaattggggtgcttggtgatgtcgtacttatccgaaaggaaaggacgcacaccgcgcagctggaggatacacttgccgccatccataacagcaagctcatcctggctcatcagctcttttcccaatttttgatagttgagagagtgggaagtttcccggccacggctctctccggtgttgtaggtgtcgatggtttccttgcccagcacggcagccagctctttgagggtagtcggctctttaccacccaggaagatggaagtatccatgtttccgataatggtatctgcgttatccttatagatcgccttgagctgactctgcgcctgcaacaccagacaggctgagatctcacggcttcggatcgtggccaccaacttttccagcttcggaatctgcccgatgttggcgcactcgtcaatgagacagcgcacatggactgggagcctgccgccatacacatcgtcggctttttcgcagagcagattaaacagctgggtataacacatggagatcaggaagttaaagctatcatctgtatcactcataatgaggaacagagcagttttccggtctcccagagtatccagttccagctcgtcataagctgtgacctcgcgcaactctgcaatatcaaatacggcaaggcgcgcaccgcaggaaatcaaaatcgacttagcggtcttgccggcggccagcttatatttcttatactggcgcaccgcaaagtgatttggcttctcggcttccagtgcatcaaacatcaggtctacggggtttttgaactcctcgtcatcctccctgacttccatcgcattgatgaactcaatgagggtggagaagttctgctcctccaccggagcctcatagtggatatagccaatgagcgcgcagtacaacagcgtctccgcttatagtgataggtaatcctttgaagttatcgccggattttcccccactccacaccggacgtgcgactttcaccgcatccggcgttccatcggttgttttcacaagcatttaatcaatcaccaaatgaaatgttagttttctattgcggacaaaccagcctgctggcgcagactgttcacttttaacatcagttcctttgttgccttgagcgtgtcggctatctcttttagctcattcttaggacactcttgcaggagtggaagaaatctattatggaacaaaatcatatttcgatagcgttccttgccgcccaattctgccggtgttttcagccagcatactatgtcagccgcattttcaaagagttccccacttagcgcacattttccacgttgagccgagaatagtgaaatcctgctgtcagtaagttctgtgcttcgccccatagacggttgattcctcaaacctgatagaacagatgagttcatacttaggttcgtgtgtatcaatgcccgtccctctaccgtgtaactgcaaaccgccgctttctttgccatcggtatcttgttcttgatgtatgcgatagggtagataggttggtcgattccagatacataccgtatcattgccgactttccaaaccgttctttttcgctctcggtcattgcgccgccctctcgaacaagtctgcacccggtttctgtattgagccgatttgttaaaactgtcatgacctgtctgtggattttcctgcaatcaatgctgatgcaggtggcaagttgaaaataattctgtattcccagaaccattgaattgtacagccgtatttcgtccaaaggtctttttccctctgaaggtcgggcaattcgtttcgcctgttccaccagtttttgcctttccagttccaactttttgtcacagatatgagattgcacgatgtacttcctgtttttcggtctgactcgtatcttaaacccaagaaactctgaatagcgttttctaacattgactatccttgttttctctggcgatacctccaacctcagcctctcggttatccatgccgttacagcctctttcgttctcaaagcgtcctctttattccggcagaaaattctgaaatcatctgcatatctcacgatatacatttctttcaaccctgttttcctcattttgaggaatgccttgctccggtcaaaagtaatcgagtttctgattttcctctcatacccgtattcctttacaagagggtggttctgccattggctctcaacccatttgtccagttcattcagcacgatattggcaagcaacggtgaaatgataccgccttgcggagtgcctttgtctggaatgagtgtagtgccgtctggcattctaatcggtgctttcagaatccgcttgataataaaaatcaactgcttgtcgtgtattcccattgcccatatttgccgcattagcttgctgtgatttacgttgtcgaaaaatccttttatatcaaactcaatcacataatgcaggttcatgcgttgaagcatggtgtaagttttctgcacggcgtgttccacggaacggttcgggcgaaagccgtaactgttgtcgctgaatttcgcttcgcagattggctctatgacctgtttgatacattgctgtaccagcctgtcccagatacagggaatacctaacggtctggtttttccgtttggtttcggaatgtctttgcgtcttaccggctttgggcggtatccgtgctgacttcctgtgacaataaacctcactttctctgcaactgtttcgggcggtaaacacccgatgtcactgatgtttttgttgtctgttcctgctgtgtagcttcctccgtttgctttgatgttccgatatgccagaagaatgttgtcccggctcagaattaaatccataaggtcggtaaaattttctccctccaaacttcgatgatagagttcatcaaaaactggctgcataccgtaatactcggcatgacgtaagtcatctacacatagagttttgtttttctttggcataaggcatcacctcctttttgcgaaagtgacccttttggtcttactcgaatccttatgttggattgaataatgcctgcttatctcaatcgacttgtggccattcctccgtagctcacataacgcaagcacatcataggttcgaccactacttttcagcagcagttcgtctgcttattgtttttcgtcagactattccttgcggaatctgctgcctttcctcgttccgatagttctatctgttcatacatacccgtaggttcctgctatagacctgtcggcttgcctgtgcctgtaacacagcatggtcgttcgtaggatcaatttctactaaaccacaccgactgcgcattaacgcacccacacatttctgcgtggtcttcttttagacctgtacattcgcaggttcgtcagtccgcccgccaaagcgaacattctaaccataggtatcttatagactctcggcttataggtaacacagtctgcctccagaccgctttcgaccactttaggcagtggttacggttactctcagcctttgtcatggggcttcgtacaccagccattacagctaatgcacgcccatcaagggtaggcgtttcagggcgttaccccgtcattccacctatcaaactaccagttctccgaacaacggaaaaccgttgctcgtgcgcagactttttaccgtctgcgaacgagtcgcactgacccagaaatcgtcgccagccttgccttcgcctttggtattggcaatcagcgtcgtaaccagcttcaagatgtccttttcgctgtgaatgtacgagaaaggattgtagtgcatactttttttgaagttgatggtattcaacaccttaatccggtatggctcatagattacctttccgtgcttgtccttcatgggctttccgtccttccccagcttgggcgcacccctttggagcatttttccgcactccaccagaattgttcccttcgggtccgtcacaacataggagctgtgcatctgcatcaggttgggtttcagccagaatcgggtcttaccggaaccggagccgccaatcaccagtacatttttgtttctggcagtcttggggtccttggggcggctgttcatggtcaggctctccgtttttgtcagaatcacattgttctgaaatacaggatcaacgtaaggtgcaatatcctcacgggttccccagcgggccgaaccatattccaaaccatgtcgatatttcttggcgttcttgcttttaagatacaccgccagcctcagaccaacaccgcagcacagccctaccaacaagtccaatggatgcaggcttggccagaaactttgcaacgccccaggcagaaccgcaaccagcgaaagaaacttttctgaagcatccgccccttgtgccattcgccatgcctctccaaaattggtagcaaacagccccagcaggatatacggcatattcagcaaaatgagctttttgatgtccaatgtctttttcatcgttccagctcctttcgcttggtgcgatccaccacagcatttttaaccatctctttgaactggttaagttttgccagtacggacgggcgctctgttttcgttgcctttttgacctttttgttggtgtactctgtaaaagctgctgtcagagcatctgcatcacggcctttgaaaaaaatcaggtactttggtggagaactgctgcgatcctttttcaccgcataatccacaccatatttccgggcgattttctcaaactccttgatagaggggtctgtgatctcaatgttggatattccctgattctgcccgacaagctgcttcacagtctgttttccatgcggaacaaccggcgcatcacggcttctctgtttttccagcttcttttccttgcgatgtgccatgtacttgcttatggcagccttaaacattctgccggtaaactttgttccactgacaaccagcgtcaaagttctgttttccacttcttcctgcattttctcgcctcctttccacgaagtttgcagggaatctctttttttgctaaggcggaaccaccagccgccgcagaagataacgcttcataccgccctccttagcgtaactggtcagaacggtcatagtgcagattgccctggcgtacctttgcgtggctcaaaatcttaatctgccccttttcctgactatccagtgctttttcataaccggtatccgacaggaacaggcgtgttcgttcgcctttccagccaacaggggaatcgttcgtcagcacatcaaaaataatcatgtgccgggtgtcctccgcaaaacgctggaggtccatatatccatgaccgtgataattctgcgctcctgcctttgcccgcatttcttccatcagctgccctatggtctttccctcagacatcatgcttactcctttctcccggcacttccgggcaataaaaatagcgaccatttaccagccgccatacagatcgtgatttacttgtgaggtgtaatgattgcttatcgtggtcggtgcattgaacagaacggtcagaagatactgcttcatgttacgaatttccgtggtgttcttctgtaaacagtccatgacaaactcaatgtgcgagttatccagcttcaagaatctggaacgaacgatttcatgcggaaaatcacttcctgcaatacgggttgtctttcgctttgcacagaccgtttccacgattagctccacaatctcatccaaatcctcccgataagtttcatactgctgacacaggtattcatacccgatattctcctgaatcaattcccgataactctctatctctgtgagtgacatcgcatcccttcctttccgttccggcagacaatctgccgcgcaatcccggaagggaatggaatcggtacttgatccataaatattttgtttttgagtatttgatttctctatatttaattctgcgggcttttccgtatccggtttatccatatacgggttttccgtatctggtgaatccgtatccggttttctaagctgtggctgctcgtatatgacatactctgtatcgctgatgcgtccctgccggtcacgcagcttgtgccgcacaatgtaaccggcagcctccaattcccgcaacgcagcgcctatggcatccacgccctccttacagatctttgcaagaccacgggtggtgtaattccagtcctctggcaaagacagcatcatggaaagcagccccttggcttttaacgacaggtttgcatttcgtaaatgatgattgctcatcacagtataatcacgggtccgttcaatgcgaaaaacggccatcgacctcactccttccgaattttgggtacaaaaaaaccgcaatcctcattccaaagaattgcggtgttcaacacttttcaaattttcttgcatagaaccaaaacagcggctttcgaggacgcgcctctgtaaatggctcctcctgggcgaaaggaagtgtttgcatcactcggtcaatatccgttgattccatgtcatgctgagatttgcaatcttcccggattgcttcttgaatttcctttaccgtacacatagtcattcctttcctttcgttgtatgggtttatgagcggcggcgttttcccggtttgaaatcgaggatatgtccctcaatcacacgagcgtaacgcttgatcttaatctcccgacgctgctggctttgcagggcagcctgatacccgtcctcggtcaaaaacagccgcatttcctctccggggctgccgtaagctgtgctgggacgcaggacggaaaactcaatcatccagcgggtgttatcccaaaacctctctacggcgagaattttgtgtcctttcagctcacgggctgaaatatccctcataggcggctcctttcatcgttcctggtctctctgacgctttttctgccatgcctccagcagcttgatgatggtttcctgcatccgctggggcgtatagcttttagggaaatacttccgcaaggtatcagaggtaaatgtcactcggtccagatcgcttttcttttcctctcccatgatgacacgcatcatatcgagggtcagatgcccctcctgactgtatttcttgagccgctgggcttgagaaagagaaggggtagcctgttcgctgtccatcgcgtccaacaggtctacctgttcctcctttttgagaaaggacagctcataggcgggatttaaggcaattttcttttcatccaccatgtccagcagttcgggaatcagctcagtcaagcgaataaatctctgaacctgcctttgactttctcctgcttgatttgcaaccagctgaattgatgtctgcgacttctcgccaacttggcgagaagttaaatctgagcgttctccctgatgttttatagcctccaacttcattttataggcaaaggccctctcacttggaagcaggctttctcgttgcaggttgctgtcaaccataataattgtggcagcgtcatcgtccagatcacggacaattaccggcatggtctctttttctgccagttcacttgctctgtgccgtctgtgtccggccaccagttcataaccaccctccgggtcagggcgggcaatcgcaggaaccagcacaccatactgcttgatactgtctgcggtttccagcattgcttcgtcatccttgactttgaatggatgccttttgaacgggtgcagttccgacagcgggatttctactactttttctctctgagcatcggcacggctctcctccgtagaaaacagatcatctaccgatgccagctctacttttttcgcgctgcttttcaagtttcaacacctccttcgtcagatttcgatacccctctgccaccttgccgccagggtcatgggcgaaaatactttttccctctgcgctgatttcctttgcacggacagagtgtggaatctccgttccaaagactttgattttacttccataggtgtcccgcagcaaagcagcaatctcttttgcaaagttggtgcggttatccaccatcgtcagcaggataccgtcaatctggagctttggattgatctgccgtttcaccttactgaccgtagatagaagctgttccagtcctttggcgggcagatactctgcctgcacgggaattatgatcctgttcgcagccgccagcgcattgaccgtaagcatccccaacgagggctgacagtcaatcaggatatgggagtattgccccttcagtgtgtccaggtattgccgtaaaatcgtttcacggctcatggcgtttaccagagaaacctccataccggaaagctgaatatccgcaggcatcaggtcaacgccttctgcatgatgcagaataccttctccggggcgtataggctgatccatcagaattttgcccattgcatccgacagtgtaactggcagcttgtccggttgcggatttcccaagctgattgtcaggcttccttgtgggtccccgtcgatcagaagcactttctttccggcctgtgccaaacctattcccaagttcgcacaggttgttgttttgccaacgccgcctttctggtttgcgatggcgatgatttgtgtgttcatgacttcacctcatttctgattgttgctgttgtttctggaaatagaaaaagccgccacttcaaaatcataaagtgacggccctttctaatgccggaatctctgaaacaaaaaaagcacccagttatttgttactgagtgcctgcattagaatcgtatttaattgttcagatttggtcagattatgccaaaccctccagcgaaaaatccggtgtctgagagtgccaaatcaccctcaaaaatacccccgaaattgctctctggttgtcctattttttaaccactaaggccgttttttgaccccatttttgccggttgtcctatatttaaccactaaaaattgggtgaaaacggctctcgtttggtcaaatcaagtcaaactatatcagcccgtttaggtataagaaaaccccggaaaaccttgattttccggggtttttgaaccattttgatatagtctgagcagtcgattatcgcttgctgaactgcggagcgcgacgagctgctttgagacccggtttctttctttctttcattcttgggtcacgagttaagtaacctgcagattttaatactggtctgtattcagcgtctgcttcaagcagtgctctggagattccgtgacggattgcaccagcctgacctgtgaatccaccgccatgaacgtttactaatacgtcgaatttgtctgctgtttcagtagcaactaacggctggcgaacaacaactttaagtgtttctaatccgaagtattcgtcgatatctcttttattaattgtaattttacctgttcccggtactaagtaaacacgagctacagatgattttcttcttcctgttccatagaattttgtactagccaatgttctttacctcctattaaaatgttaatacttctggtttctgagctgcatggttgtgctctggtccagcgtatacgtgaagttttttaatcatgcttcttcctaaaggtccttttggaagcatacctttaacagcgagttcaagaaccttttccggttttttagccatcatttcttttaatgtggtttctttcattccaccaacatattctgagtgatgatagtaaattttctgatccatttttttaccggttacagctactttatcagcgttaacgatgattacataatcacctgtatctacatgaggagtataaactggtttgttttttcctcttaaaacttttgcaacttcagatgcaagacgacctaatgtctggccttcagcgtccactacataccattttctttcaatcttatccggattagccatataagtgttcatggttttacctccctaattttcaacatatcataatctgattacttcataaataaaatttatatgaaaatactataccggggcttttggctaagtattttcgcactacgtcacattgagatattatattatacttaccctttaatgtcaatctttttttaagaaatattacaacatgaaacgcaaaatctttcttgttcttttttctctcacgattctactccgattttcgggcagatatcatttaagcagcattgttcacaatgcggttttgttctcgccgaacagacttctcttccatgatataccagtctgtgacagaattcactgccttcttccggtggaataattttccaaagtgccatctccactttctttggctctttgattccatctacaagccccatgcggtttgtcaggcggatacaatgcgtatctgtgacaatcgccggctttccaaatacatcccccataatcaagtttgcactttttcttccgactccaggcagttttaataactcattaaaatcatccggaacttttccgttatatttttcttttaacatacgcatgcaggcactgatatctctcgacttgctttttccaagaccacatggtcttacaatttcctcaatctgctctggttctgcttttgcaagtgcatccacatccggatatttttcatataatttttctactacaatattcactcttgcatccgtacactgtgcagcaagacgcacgctgaccagaagtttccaggcttcattgtagtctaaagtacaatcagcatctgggtattcctctttcaatcgttttatgacttccaaagccatttcctgtttttccattgtattttctcccgattatcattataaagcggacattcgcatccccctcacccgccgcttagtgctctgcgcacttgaagcgtgggaatgcttatctgcgttcaactattttatcgcaagccgattaatctgtgttgcaagataacccgcaccatatccgttatcaatattgactgttgcaattccatttgcacaggaattaatcattgtaagaagtgccgataatccatgaaaacttgcgccatatcccacagaagtcggaacagcaatcaccggcacatctacgagaccaccaattacactcgcaagtgctccttccattccggcaaccgcaactacacaattcgcatcctgaatttctttaatattaaaaagcaaacgatggattccactgactcccacatcaaatactcgctctactttcgttccaaagtattctgccgtctgtgctgcttcttctgccactgcaatatctgctgttccggctgtacacactgcaaccagcccttttttttctcttttctttccatctatttttaaaattccggaaagcgggtcatattctgcagccggaaatttttcttttaccagctcatattggtgtacagaagcccttgtcccaaatacttctccgtttttttcatataactttcctacaatatgaagcaggtgttcatccgcttttccactacagaaaatcacttccgaaaagccggaacgaacttctctatgcatatccagtttcgcatatcccatttcttcaaacggctctctcttaaaataactttctgcttcttctattgatatttttcctgattttacctgttctaataattctcttgtttccatttctatttcgattgccctttctgactgtcaaataatttgaaacagctttattataagcatttcactaaaagaaagtcaatcttaatgtagtcgctcaaaaaagaagtacctgctcatttttgcaaatacttcttttttcaaaatttataccttttgatacggcattttctgatacataatttgttcaaattcctcgacaggcattggatgtgcaaaccagaacccctgtgcttcttcacatcctgctgttcttaacacatcaacctgttccagattttccacgccttcacagaccacacgataaccaagccctttcactactgcaacaatctgatgcagaaaatacattccacgttcacttgtcttacagttatccataaaaactttgtcaatttttaccgtattaaccggaatgtcaatcactgtgtttaaaagggaatagcctgagccaaaatcatccaatgcagtctgcatattgactttctgaaatctttcaaacaatcgttttacgttgtcataatacgataccgtcgctgtctctgtcagttcaatttcaagcaaagcagggttaattccataacgatttaaaatctccagataatgctcaacagtatcacaatctcttgcgtggaggattgaagcatttaccgaaatcggaatcaattttctgccctttttcttattttctgcaagaaactttacaacttcttcaaatacaaaaaagtccaaatcaataattcttccatttctttcatataaaggaataaatgcatccggtatcataacagttccatccggtctctgccatcttaccaccgcttccgcaccgataatcgaataatcaaaaagggaaactcttggctgtaaatagattttaaactctctgtttcgcattgcaaggtcgaatccattgataatttcattttccactctttgtttttcttccatctcttttccgtaaaccttcacactgattcctgttacctttgagacttgtttccttgcataatttgccgcatcaattgcaatagacgtatttccatttgcttcttcaataaaataaattcctgtccgaatccgaattctggtatccggaaaaattctttcctgctgttctacaaaggtttgatttaaccgatctactgcctctgcggtatcacttctttttttatacggcataaacaacaaaaactggtcggaaactatgcgggtaaaataaatctgttcttcctgctgcatcgttccgataatataattactgaactctctcaacagacggtctcccatctgatatccccatttctggttaaaatacttaaagttctcaaaatctgtgtataccatcacataagaactgatactgtcattagcaagcactcgttctacttcttctttaaaacgggtaaaagaaatcaaaccggtcaaatcatcaaactccggatttgtaaacattccattactcatggaattcattaaaaacaattttccaagatgtgccgcaataatttttgtaatttcacctaaaatctgccgttcttctttcttccaactgcgtttttctttacaaaccatataagaaaccgaacctgcatatttcccctcataatagattgcagtatgcaccgctgttttggcatctccatgaagcagagtttgaattccatgttcactataaccaagtgatttcatctcgtcttcctgaagcactgtcgttccattctcatcataactgtaaaataattttaagaaatcctcttttttataatttattttctgttccaatgcctgcggtacattgtccgctgtccactgatacatcttctcgctcatattaaccttaatatccgtacgaaacacagtaatacgatctaaattaaaacttttacctacaatttctaataaactgtttactgcactgtcaaagtcacctgctttttcaaatgtttcaaatgccgttgccaccagacttcccctgtatccggatatcggtctttttcctcttctgtgctcttctattttttccttcttttcttctacactttgaaagcgctgaagactatcacaaaatacatactggtctcttccgttttcttttgcacggtataacgcccagtctgcattttttaatatctgttcataagtatatcccgaaacattttccggaagataacacactccaatactacaggtcatagagtattctttttcctgaaaagtctgattccgaatcgaatgaactaactgcatagctttacgaaccaatgctttattgggaatatctttgaataaaattacaaattcatcaccgcctgcacgcattacaacatcttttttatcacagaccataagcaacaattttgccaaatcctttaatacaacatctccaaataaatgcccataattgtcattcacatctttaaaataatccacatcaataatcatcagaccacaagcggaataagggtcttttgttcttagatatttttcaattaatttcgttcccgcccttttattataaagctttgtgagtggatctctctgcgcttcttcctgcagttgctcttcccttcttctctctatcgtaacatctctgatacttcccagaagcaccgactcttcattcagactttttggaagataaaccgaatttaaattctttcttgaaatcaaaccttccccctctacatatctgatttcaatcgaatttcgtacttctccattgcaaaatcctaccattttccacttatcttccggatgaattttatcttctttttgcagatattccataaaatgttcaattttttgaagcatctgaaactgaccgtcatataaaataaatacttccctttccgggaaatattcaaataataataattcttttcgttttatcatagaagccaaaattgcctgcctgtgttttaccctcataaccgcttccgtatctttgcattcacctttcatacctcttactccctatattttttatatccatactataccgctctcataccttattttaaaattataccaattttttttaattttgtatactagccaaacggcttgtattctgttttaaactgcgttttttaaccgaatcaagcaagtccctgtcagtaaaaaaaagatgactacacaaaatttaaagtgtagtcatcttctgtctatttcttatttttctataacgtattttagtttgctgcaagctctaacattctctttaatggttttcttgctgattcacgaagttcttcatctaattcaatttccggtgccattttttcaagactttctaatacattttccaaattcacttttttcatatttggacagaactgacgatgtccgactgaatagaattttttctctggatttttctgcattaattcatagaaaattcccatctctgtacagataataaagctggttttttctgaagaagttgcataatcaataatctgtgaggtacttccaataaaatctgctacagaaagtgtatccggtgtacattccggatgtgccagaaccattgcttccggatgtacttcttttgcttttaagatatcttctttatgaatgctcttatgtacatgacagaaaccgtcattaaaaataaaatgtttgtccggcaatttttctgctatatggcgtcccagattttcatccggaataaagaaaatgtgttcatttggaagcttctttacgatcttgagcgcattagaagaagtcacacagacatcagaatgtgctttaatctcagctgttgaattgacataacagacaactgcaacatccgggtactgttctcttacttctttaattttttcaacatctaccatgtgagccattggacaatctgcactggactctgccattactacttttttctcaggatttaaaatctttgcactttctcccatgaatgaaactccacagaataaaattgcatcttcagatactgttgtagccttttctgcaagataataagaatctcccacaaaatctgcaattgcctgtacttccccatccacataatagtgtgccagtattactgcatttttctcctttttcagtctggcaatcttttctttgatttctttgttgctcatattccttccccttttcatttggtttgatttttaaaaagcacaccaaaagcgcactttcttattattactcttcctgactgtcactctttttacttccgcgcaaatcataatcatccagaaaattgtaagcttctttgtctttgtgataaccgataaccgttcttaaatttatattacggacactgttaaaaatattggtttcgatcacatcgctggtctttctaaactgcgcaaccagttctttcatctcatcacgttttgaacctctgcctccgccacagctgacgcagttttctgtaaaacgacatgcacactggataaaatgcagtccgttgtaatctctccatgctttaatcgcatcttcttttaccatgtataatggacgaattaattccattccctcaaaattctggctgtgcagcttcggcatcatggtttctacttttccgctgtataacattcccattaaaatggtttcgattacatcatcaaaatgatgtcccagtgcaattttattacatcccaatgcctttgcatgagaatacagatagcctcttctcatacgtgcacataaataacatggatttttttcgattgttgctacagtgtcaaaaatttcactttcaaatacggtaagtggaattccaagtaaatctgcattatcctgaataatcttccagttatcttcattatagcctggattcattacaagaaaaactgcttcaaaatgaatttttccatgacgttttaattcctgaatcagttttgcaagcagcatggaatcctttccaccggagatacagactgcaaccttatctccctcctgaatcagctgatattcatttaaagcttttgtaaacggacgccagatggatttccgaaatttcttaataatgcttctctcaatttcttttgtcttttcttctttgctttcttttgtatcttcttccagaaaacgacttaaagaaagacgcagataggcacgatatccaccttctacattaaaagcattgtatccggcttttgtcgctgtttcaatataatccttacttctctctccggtatgacagataaagtaaattggtttttctttttccaacacttcttcatatcgtgaatcaaactcttccatcggcagattcactgcccccggaaaacttcctcttttgtattcttcctccggacgcaggtcaatcacctgaatctcatctgcacttaactgttctaattcttctacctgaattgttttcataacttcctaaatcacctgtattaaaatcatatttacggctgttccaagcaaaatactaagaaacgtattatgcttccatttataactgactgcaacaactgccactgccaaaaaatttgcgattcctgtgtgagaaaaatcactccctgtttcctttaaacaatacacaatcagcacagccataattgctaatggcaggatttttccaagataaatcagtttttccggcattttgcgttccccacgaaatgcaagaaacggcaatgcacgcaaaaaaaatgtaatccccgccgacactgccacaaccagaaaaaagaactctatcttcatgactgtgcctccttttctctcatcaaaagcagaacacctgaaacaagaattaaagaaggcagcataaagcttcttgctcctgctataatcagacacagcattgagattataagacctaaaacggccggtacatgattctttgttttctcccaattatcgataaaaataatgacaaacaatgcggtcatgcaaaaatcaattccctctaattttatcggaatcagctgtcctaaaactccgcctgcgactgtacctgccatccaataacatcttgacagaaatgcaatcacaaacatcatgtcctctttttcttttccggtttccatcaggcttaaattaactgcataagtttcatctgtcattgtatgaatcatataaagaagtcgttttcccatcttcttaaattcatctacaaacgttaaactataaaaggtctgcctgctgttcatcaaaaatgcagtcaccgcaatcgtaataatagaagttccaccacttaaaaatgaaaccagcacaaactgaaatgctccggtatacacaaccaggctgataagcagtgactgataccagacaaatcctgcttcttccattgtaattccatatgctatactgacaaacacatagctgcataaaattggaattgactttaaaaatgctttttttacggtttctttctgcataaattttatcctaaagtatcgccaaattttggttttcaatccgttagtggcatagtatcactattgagaaaccttgtcaagtgaactactctgctacaagtaaccgagcttcttgcttcaatcaccactgctatacaaatacaaaaacagtatctgcatagtcttacaatgtcaccttttatttttgaattttatattgactttttgccagattctgctagaataatgccttgtaaaattaagtagtggatttttcctgacggataaaaccgtctcttttcgccacacagcaagaatgctgtgtggctttttttatctccaaaatctgctgtatttataattcaaaacgaaaggaaattaaacacatgaatgacaattttatgaaaaccaaaccggttttacctttgcttttatctttagctctgcccatgatgctgtccatgcttgtaaattccctttacaatattattgacagtttctttgttgcaaaaatcagcgaagatgccatgaccgcactttctttagtctttccaattcaaaattttattaatgccgtagcaattggatttggtatcggaattaatgcagttgtcgcatatttcttaggcgcaggcgataagaaaagtgcaaatcaggcaacaacattaggtataattcttgccattatccatggaattctcctgactgccggaagcattttacttattccatattttttaaaaatgttcagtcattccgaaaacgtaatttcacttggaattgaatatagtaatattgtatttgctttttcactgattattatgttaaatgttggatttgaaaaaattttccagtctgtagggaaaatgaaagtaacaatgtttagtatgatggcaggctctataacgaatattattttagacccgcttcttatcttcggtatcggtccatttccaagaatggagattaaaggagctgctattgcaaccaatatcggacaacttgtctgcatgactatttatcttttgatttttattttccgtccgattcaggtaaaaattcagaaaaaatatgcgacactggattttgatttaatcaaacgtttatatgcagttgggattccggcaactttaaatcttgccctgccatccctgttgatttctgccctaaatgcaattctagcttctttttcaggagtttatgtattaattttgggtgtctattataaattacagacctttttgtatcttccggcaaacggaatcattcaggggatgcgtccggtaattggatttaattacggtgcaaaagaatataagagggtgaaaaaaatttacaaaattgtccttcgtatgagtgctggaattatgcttgccggaacacttatctgttttattattccagatgttttaatcggattatttacaacaaatcccgaaaccattgaggctggaaagactgctctgcgtatcatcagtattggatttttagtatcttctgtctccattacttcttccggtgctttagaaggtctgggaaaaggagtgcagtccttaatcatttcactctctcgatacatagttgtaattatccctgctgcttttcttttatcacgagttcttggtgcagcaggtgtctggcatgctttctgggtatcagaagcaataacggcaatcgtatctttagttatttatcaaaaaacagtaaaactaaattagacttttatttaaaaagagcaaatagccagtacttgtacttattcctgaccatttgctctttcttttctgctttttagatttgaaactttgcacctatttcttctttttctcataacatgatatcatatcctgcctaaaaaaaatgaggtccctcttcatgaattcttattgcagttctatcctttttgaccacggtccgaatccctttacaatcaatcttagaaatgctgcttcccataactgcaattcctgtactaccctctggagcggttcttctcttgaacttaaacttctaaacattctgccatggaaaacgaccggatggaaacagcatcctgaaaccgatcagatcattcgtattgaatgtggcacagctcttctgattctcgcttctaaaaaatgccatcctaattctcaaaaaacgcttcataacggagacgccgtctttattccagctggaacatggtataacctaaaaaatatcagcaagtgtccgttaaaactttctttggtacagatttcatccaataacttcaaaaactaattttatgttttttggatatcatagttctatgttctgtggtaaaatattgtaaatgtcaaaatctaattttttactgaactaggagatgaaagaacatgaaacactacattgattttattgcagaacaattaaagacattaactgcaatcccaagtccatccggctataccaaaaatgcaacggactacctgatgaaactgcttcaggacatgggatatgaaccgaaattatccagaaaaggaaatgtgtttgtaacccttggaggggacggtgaacctctggttttagctgcgcatgttgacacacttggtgctatggttcgctcgattaaagacaatggacgccttcgcccgaccacacttggcggacatgtctggagcactgccgatggtgaaaactgtaccattcatacaagagatggcaaggtctacaccggtgttgtcttaaacactgagccatccgcccatgttgccgataaaaaagtagaaacccttgaagaaaatatggaaattttactagatgaaccggtttctacaaaagctgaaacgcttgcgctcggcatccagaccggagatattatcgccatggaccctcgaacagtcattaccgaaagcggttatatcaaaagccgttttcttgatgataagctttctgcttctattcttcttggaatcgcaaaaattgtaaaagatgaatctctttcctttcatcggaaagtttctttattatttaccgtctacgaagaagtcggacacggcggaagttttgttccagaagatacaaccgaaatgatttctgtcgatatgggatgcgttggggcagaccttggctgtactgaacggatggtttctatctgtgcaaaggattccggtggtccttacaactatgatttagtaacggaactttccaacattgcaaaagaagaacagctcgattatgcgattgatgtctatccgcattacggctctgatgtagaagcaactcttcatgccggttatgatatccgtcatggactgattggtcctggagtttacgcttctcataactatgaacgttctcaccttgatggtgtaaaaaacacatttttattgctaacgacttatattacccgataattttttaaccaaatcaaggaagtcccctgcttcaattgccaaaagcaataagcaagggtcgggacttgcttgtatcaggagggggcaagccccttctgataagctgcgtagcagctatttggttatgagcaagtagcgaaagcggattgcgaatatccgcttgacgtattcaaaaatccgcagccaccggaaagttaaacttcccagtaactgcggattttttcttcgtttagatgttccccgattacaatctgaatttcctgtccctgaggaatcggactgatacaaagttcatcctgcgttgcatttaattcaatccagcttccatcttgattctgactaaatcccttgatacgaaataccttgccacaagatgcatcttctaagatttttttcacctgtgtttttaaagtctcggcatctaatttcacatccataaaataaagagattcaaacccactttcctgtgatacatccctcttttcataagactcctgaacatatccggcttctgcaatctcggaaaaatcatcttctgataattcactgccatctcttctcataagcatctcatctcctaaaattcgattgcactgaatctctttcaaagactgatttaaagtggcaatagttgtattgatttcttctttcgtcgcttcttctgaacggctcaaaataatctttccagcatgagcagcttctgatgccagaagataccttgcttcctctgataaattcttctctgattttgcatttacaaccgtaatcacacttccgatttgataccatttatctaacggttcatcacgaagcacatcaaaaaattcatccacatcataaattccggaaggctctactaaaattcggtcataaccacacattcccattgcaattaattttgtgcgaaaccgtcttctatgtgtctctttatcacagcctccggctatcatttcgagttcacatttttcgccctcaagttcctgtaacagcatcatatctacattgacagcgccataatcattttccaaaatcccgatattaagcccttgacttattaaatattctgcatatttttttatgaaagtggtttttcccgagccaagaaaaccagtaattaaatcaattgtaaccatatttacgatcctcctttctttgttcctgatacatctttttccctcaattttcttcggtttttcgcatatcattctatcatatttttttggagcagaccagatattctgcctgaactttttattgactttttttatcaatcagcgtaacataagctaccgaaaaagaattttttaccaattataaggagaatgatttaagaatttatgacaacaatgaaaacgcaaaatcccctcggttatgaaaaagaatccaaattgcttgtcaattttgcaattccctgcattatctcaatgctggtgacctccctttataatattgtagaccagattttcattggacaagggattggcatgctcggaaatgccgcaactaatatcgcatttccgctttccactacctgtaccgcactctctcttttactcgggatcggaagtgcaactaatttttccctgcatttaggggctggagaaaaagaaaaatctgcccgctatgccggcaacggaatctttctgatggcagtattcggactttgtctgtttcttgcaactacactttttttaactccaatgttaaaatttttcggtgcaaccactgaagtcctgccttatgccaaacagtacacccgcattacagcctttggttttccatttttaattgccaataccggaatgagtaaattaattctggcagatggaagtccacgatattccatgatttctatgttaatcggtgcgattgtaaatacaatccttgacccgattttcattttcggtctgcatcttggaatgaccggtgctgctcttgcaaccattatcggacagattgtttcttttagtatcagtcttcattatatgtttcactttaaaaatattgtgctgaatcgaagctgctttcaaattcagctgtcttactgtaaagaaattttccgacttggcgcaagtgcctgttttaaccagattgccatgactgtcgtacagattgtaatgaacaacacactggcacactacggggcaaaatccatatacggaggtgatattcctcttgcctgtgccggaatcatcacaaaagtaaatatgatttttatgtcctttgttattggaatttcacagggtgttcagccaattatcggatttaactatggggcaaaaaaatataaacgtgtacgaaaaagttatctgcttgcgcttggtgttgcaactgtgctttccggcattgcattcttctgttttcaggttttcccaagacagattatcagtgtattcggtgagggaagtgagttatattttcagttctcagaacgttacttccgaatttatatgtttttaaccttaatcaatggaatccagccggttacttcaaacttttttaactcgattggaaaagctcaactcggtgtctttatgtcactcaccagacagattttattcctgcttccattaattattatcttcccactttttatgggaatcgatggtgtcatgtatgcaggaccgatcgccgatgcagctgcggcacttgtctgcggctattttaccattcgggaattaaaagagttgacacaattggaaaaattaactctgaatctttaagttcatgaacaaaaaagcttgtcctgaataaattcatattcaagacaagctcattttaaactaaattttaattgactttacttcattttcttttcatttcagttttgagattaagataacggaatataccgataataatgacaactgtttcctctcgtttccggtccggcttcttcataccagttatactcaatttcttcgttttcgtctgcccaaagttccggacaatccgtatactcccaatccaccggaatcttatgttcttcctgcaaggatgcttttaacatcatctgatgcagttcttctttttcggtttcatttaatacacccggttttgctgacacaaaaagtgatgtaccggagcgtgttactaaatctgcccactgtgaatttaatttccacggaatattttccataattccaacgcagtctgcatcaatatcaaaaaatgttccatgctgaggcagacaaaatgccagcgtattgactcccatcattttggtacgctcccaggtttttccactggtatcatccccggttctctgcatgtgcatcaaacctgcacccagatgtccaatcgtattgcatcctaaaatcatcacatgatattctttggctgtctcataaattgcacgatataactctactacaatttcagcacttgttttggatttatcataaaagctccagccatccgaggttgggaacggattcatctcaagtccccatctgccaaataaatcaaaggttgtaaaatcatgtttgattaaggtatatccccactcgcagattcgtttgacatcttctttaatataagcaagcgcctccggatgtgacgggtcgagacagccgttgtgagaaattctccattcttccggaatcgtctcttcctcatttaagaggaaacgaacccagatacccggacgtacccctttttcttctaatttttttgcaagtgctcccatgtccgggaatttttcatttccttttttccatggtcctccattgtattcatccagccgatgatgttcctgccagcaatcgtcaatgaccatataaggacggttttctgcgccttttgtaatgtctacaatataatcggtatcctgtaaaatttctttctctgagctgtctccatatgcataataccagttgttgcttccatagaccggaaaatccggaaaaatcggatccgtgcacatgcatttacaaaatgcttttgctgcttcaaaagaggtacaatcatctgcctgcattgcaaccacttcagctgctaacagctttcttcctgaaagtacaacccccgttccaccacagcgtacatccaaaactaaggtaattcctcttgtatcagcctcccagaaacacatggcagaaggacgaacttttacaccatatcctgtcacgactccttcatttaatgcaagaaaataccaaggcataaagcgtgttccgctcattcccttccattctgcatctccataagttctctcccagactccgccaagaatctttgacgtacgctcaagcggagtattccagcgaagctttactgtttttaccggtgagttatctgccgtaagccagatttctccattttcatttgcttcaacacaaatatcttctttttcaaattttgaactgttttgttctccaataaaagaaccttcttcactctctactgtaatataagatggtactcctaattttatttctcttttcttcataactttttcctcatcatatttctccatgaaatgcaccttttcggttttcaaataccaattcttcttttgtctgacgaaacgctttcggacttatatttgtatagagccggaacattttcgaaaatgcaagctgatccggatatccaactgcctctgccaccgcattaatcggcatatctgtattttttaacagattttttgctttttccatccgaaattttaccagatattcctggggcgaacatccaattgtttttttaaacatattcgtcagataactgcgattaatcccgatatattctgccagctcattaatctttattttttctctgtaatgatgttttatatactccattgcatgttctacatatacagtccccggataggtatgctccggcatcgtttttgtattaaatttctcattgtcttctattaatgtcgccagaaacaaattcaaatacccattcctacgcatcgattcctccgttgtaagtcgatgcacttcaagtatctcatccacatacgattttaaaagtgctgtacattttaaacttcgaattgatttctcttttgaaaatcccgcatactgcattactttttttactttataaccatacagcccaatccatgcataggcccatggctctttcttatccgcttcataccaggcttcttcttccggacaaagtaaaaaagcatcgccggttgttagatgaaatacttcaccattcttttccagcttcccttttccatttgtaataatatgaagcacataataagtccttttgtttggtccaaaccgatgtccgggataacatcgctcccatccacaatatccaagacttaattctgccgaatcaatcggcaaatcttccaggcatttatatctcccctcattcgtatatgccgttacctgtgtcatatcacacttcctcttttttataaatgtgatgcggtaaagtcaccttttacagttcccaattgaagttcttcttttgcttttcgatattcttttgggctcactgtaaaattctgtttaaatatctttgaaaatgcaagctgatcctgatatccaaccgcagctgctaccgcattaatcggcatatctgtattctttagcagattttttgctttttccattcttaaattcaccaaatattcctgtggagaacagcccactgcctttttaaaactgctcgtcagataactacggtttaccccaatgtaatctgccagctcattaattttcaccttttcctgataatgatgtgaaatatattccatcgcatgacgtacataaaccactccgggataagagtgctgctgtgctgctggttccgtcttcttataatcttcaatcaaggcagcaaaaaacaacatcagatatccatttcgtttcagctcatcggtgtaggaaagctgatgtgccgccaaaatcccatccagatactgattcaactgttctttacattctacatgcctgataggatttctcctcgaaaatcccgcatgttctgcattttcttctgcacggtagccggtaaatccaacccacatataacaccaggggtctttcttatctgcttcataccaagcttccacttccggggcaatgaaaaatgcatcgccctctttcaactcatatttatgtttattaatttcaagtattccttttccgcttctcacaatatgcagtacataagacgtccgaagattcggaccatacttgtgtcccggattgcagtattcccaaccacagtaaatcagacacaaatctgctgaatctttttgcaaatcttccagacaacgaaatctggcagaattggtatatccggctacgtgtttcattctttactcatccactttctttaaggtatacagaagtgatgcaaaatctccgccttttttattcaattcttctctgtcaattggaattccggcgctcatcaactcatcaccataagcctgataggtttttacactgtcttcctctgttttatgaccataagcttctgcaatttttgcatcataagaagtaaccggtgccatatcgcagctcacttcatattttgtattggcatcaagtccatccagttttaaacgaagccaggacgcattgactttatttaatctctgatagaatgcagccaccgcctgtgttttatcgctggaaactaccatccatgcagtttcatttccttcaaacggactcaacagacgatagaaatcaccatccatttgaattaactctctgtgttctttcataaatgcaatctgtttctttactgtctcaatttcggcatcgctaagtaagtttaaatccagctcataaccaaatgttccaaaataggcaacatttgctcttgtctcaatcggagtaattcgatgcatctgatgattcggaactgctgaaacatgggaacccatactgacaatcggatagacataagaggttccatactgaatctttgttctttcacttgcatcggtatcgtcagagcaccaggtctgcggagcaaagtataacattgcaggatcaaatcttgcaccaccacttgcacaggactcaaataaaatatgcggaaattctgtcgtcagtctggtatataaatcataaactccaaggatgtatttatgcatcacttttccctgctcacaaggcgcacttcctttgctgtaaggttcagacatatagcggttcatatcccatttaatataagaaattgaagattcgcggattacttttgcaatcatctcataaatataatctaccacttcgtttcttgagaagtccagtacattttgatgtctcgcatgagactcaaaacgatttggtgcactgataatccagtccggatgtgcacgatataaatcactatccttgttaaccatttcaagctctacccaaagaccaaattttaaccccagttcttctacttttttagagagccccgaaataccatccggcaatttttccaagtttacataccagtcaccaagacctctgtaatcatcatttcttgcaccaaaccatccatcatcaagtacaaataattctacacctgcttcttttgctttttttgcaattgttaaaatcttttcttcattaaaatcaaaataggttgcttcccagttatttaataaaattgggcgtgccttatctctccattctccatgcatcagacgttttctgtataaacggtgataggtctgactcattttatttaagcccttatcactgtaaaccataacaacctccggagtctggaagctctctccactctttaattcccagctgaaatcttccggattgattcccatcatcacacgagtcatatcaaaggtagaaacttcaacctgtcctaaatagttaccgctgtaaaccaggctgaatccatagacttctccctgactttctgtcgtatgtggacgttttaatgccaaaaatggattatgctctgcgccacagcaggttccatttaaactctgaatactctggattcccatttccagctttctgttttttacgtaacgctcacgtgaccatccaccggaaagctgaaccatttcataatccatatccaaaaattccacactggcactcatggcacgttctaatacaattttttctttccctttatgtacaaacttcgtatttcttgtaataaccggatacgcctcataaatggtataagacaaaatcaaatcagtatccatcacgttatcatgcagagtgacttcaagagtctctgcttcctctttttcctctacataagttgccggaagtggaaggatttcttttttccctgaatagatttcatgacctgcatatttaaaatcaataatacggcttccattttcctgtgcaatggtcactgccggacttctatagtcaccggttccataacttggatattcctgtctggtatactgcatggataacagacccggctccggaatacaaacagacatctgagaacgcattgcttcatcatggaaataagcaaagtcttctttgtcatggattttctttccataatataaattttcaagctgtccattttccataatacgcataatataacttacttcattgttgtaaagatgaaaacatttgctttgtttgtgaaaaataattgccatatcttttttctcctttttctaaaaagaccgacgtagaactctacgtcggtcttaaattcataattaaagttttccaccacttgttgcaataccttcgataaactgtttctggaaaattacataaagaacaatcatcggaatacatgcaatcagagaagcagccatcagttccgggaacttcgcagcatactgtccctgcatctttgcaagtgcggaagaaagtaccaacatgtctttatccgtatttacaatcatcggccacatcaaatctttaaatgcaaacactgcggtaaagatgcccagtgctaccatactggatctggtaagtggtgccataatgtataagaatgtctgtccgatattacatccatccagacgtgcagcctcttcaagatcatttggaagtcccatatacccctgacggagcaggaaggtaccaaatgcggtaaccatacccggaaataccagaccaaaaattgtatttaacattcccatcttacttaccataatatactgaggtgagatgaaaatctgtgccggaaccatcatctgcagcagtactaaagagaaacagaaatctcttcctttaaaatgcagacgaccaaacgcatatcctgccattgtcgcagttaacactgcacaaagtacacggaagaaaatcattaacagtgtatttttgtataatacaaagaagttcatgttacgaatgacttctttaaatgaatccgttctccatacctttgggaaaataacaaacggatcgacacttgttgcctcagtaactgttttaaacgcggttaaaatcatccatataaaaggtaccagcatcgtaatggatacaagaatcaagattacatggattaaaactttcgtaaagttctcttttgctttcatgttgccttccatactgcttcccccttcctagttgtagaatacccattttttctgtgcagtcatctggattgcagtgataatcaaagtaatcaccaaaagcagaataacaattgtagaaccataacctatgttcttatttgtaaaggtatatttatagaataagaatactaaggactgtgttttattaagtgccggatttgttttatccataaccatgtagatcaaatcgaatacctgtaaagcaccaataatacgtgtaatcataacaaaaaagatggttggggataacaacggcaccgtgatattgaagaaacatttgattcctgttgcaccgtcaatctcagccgcttcataataatcatgcggaatttcctgcagtccagaaataaacaataccatgttataaccaatgatagaccagataccgattactgcaattgaaaaaactgcaatccttgggtctgaaatccattttgtatgtaaatgaaacagattgttgatcagaccaaaatctgagttaaacagccatctccaaaccatggcaactgctgccggagctgcaaccatcggtagaaagataatggtacgataaacagaacgtccgatcatctttcgatttaagaacacagccagtaccagcgcgataataattgaaaatggcacttctacgattgcatacttaaatgtattaagcaatgcctgccaaatttctttatcggcgaatactttctgataattttcaagtccaacaaagatatttcctcttccgaaatctccggttttaaagaaactctgataaatcgtctggaaaatcgggataatatttaatacaatcaaaccgattactgtagggagaataaaaagccagccccagataaattcacttcgttgtcttccggttgtttttactttcgtcttacctgccaaaccactcactccttttttaatacaggcagattctttcgaacctgcctgtgtctcttgctttcattctacttcgttacactataaattgcgttacaaattactgctgttcttcagccagtgattcgttcatctgctctgccatttctttgcaggcatctgccatagttttgtcaccgctgtaaacactcttaagaatttcactattcttgttttcccatgttactgtagaacgggagtatggtctgatctccatatcatccatcatattgatgtaagcctgaagattaaagtttgcggattttgcccatgcttcagatgttccggtataagcagacattgtaacacccagttcagcctgtttttcctgtgcttctttcgaaccaaggtattcgattaactgccatgcttcttccggatgctcggtatttgcggatgctgcccatccaagaccattgtaaagagaagctcttctgcctgttgttgcgctctttggaagttctacacaatcacagttctctgcggtgtattcgttatcacggaatgttgcgatcatccaggagccctgtggaaccattgccactttaccggattctaataatacatcttcaccgttttcagacattgtctcgattggaggaagcacaccgtctttgatccatccttctaacatttccattgcttctaccgtttttggatcatccattccggattttgttttgtcatcattgataatatatccgccattatcatagatcaggttgtagtaaccagcctgattgttatcatttctaagacataaaccatactggcttccatcgtcttttgtcagcttcttcgctgcttctgtcacgtcatcccatgtccagtcagcggtcggatactctaatccggcttcgtcaaacatttttttgttataccataaagcaatcgtatcgatatcttttggaactgcgtaatatttgtcatcgtatgtatacagtccccagatatcttccggatagtttgcagggtcaatttcactgctctctgcaattttatcagtcaaatctaataacatgtcatttgacatataacgctgactttcgttagaatgcatccagaatacgtccggtaaagaaccacctgatgcaccagattccagaagtgtccagtattcatcccattttacaacagaaactttggttttgattccagttttttctgtgaaatcattcataatttctgtcaatccaggttcctggttggaatcccagattgttacggataattctacgtcccctgaatcactctctgattttttgtctgagctgtcgcctgaacttgagtccccgcttccgcatcctgccatggtaaataccattgcgcctgtcagtaataatgccattgcctttctgaatttcataattttttcctcctttaatgaaaaagaatattctctataagtagggttgcttcgtccctcactcatttgatgaattcattatatcgagatatgtcaaaatgtaaaatggaaatatgtttttaatatatggagaaatgttgtttatttgtgcattttctatatttttttgtcttattttctttttcaacagtcatttttatatttatatgtctggtttttcacaattttattcggtgtttttccaacaaagctctctttatatttccgattttgctttcatttttccacatatacataacatttttccatatccttttctttttatttgtttttaaactatatttatattcaaaatacccgatatctggaatttttcttttttattttttgcattttgacatattcaatgttaaaataaggtatcgtgcaattttacatcacttgattttttgacgaaaggatatgattttatgaattttatgaaccaggacaacattgtcgtaattgccttaaaccggattggagatgttatcattgcaaatctgctttttcttctctgctccatcccccttgtcaccatcggtccatcccttactgcactatatcactgcatgttacgtatcgtaaaaggaaatgaagacaaggttactaaaactttctttcgggcattacgtcagaattttgtgcagtctttgatcgcctggcttgcacttgttatcgttggtgtgattttgtttttgaacactcactttctcctgcagaatacttcagaagccggaaaaatcttttattatctgtccgggctggtacttgtactgcttgttattatcgcactttacatctttccggtcattgcggcattttccaataccttaaagaaccttgctaaaaattctgttatttttgcatttatgcatattccgtccaccttgttaattgcagttatttctatcctgccaatgtatatgacttatcaagatttaacacttttaccactctacagctgctgctggtttttcttcggctttgcattaacctgctatattaattctttcttgttttatcggatttttaaaccgtatctggaaacaagcgaagaaaccgaagaaataaaagaaatctccaaataaaaaaatttccgaatagtaaaataccgacaaatgaatttttattctcatctgtcggtattttactattcttcctcaaattcatctcccacatctttcccaaggtcgcaggtataacgccattcaattacatccccgtcactgacctcatatttggaacatccataattgggaaaatatccattcacgctgtaagtccatccagaacgttctccacagtcaaattcatacaactgattaattccttttacataatacgcagaataaagcggagtatagtttgcatccagctgaatttttttctctttacagacacgcgcaagtatatcatagacggtatcacccgtttcatatttcacctctatcggttctaaaatccagccatctgacggaacaaattcctttttcgatgcttttaactctttctcattatccaaaatagtagaacattcaatggaaaccgtacatttattcttttctacattctgtttatttgtctgctgtttctcttgttgtgtttcttttgtttccagttttgtaatctcactgctgtttgtcattccaccacagcttgtcaaaagaaaaagaagtgtcagacaccctaagatttttctaaatttttttctcatcctttaatcctcttctatcattccatacttcactttgattctctccagtttttcaatcatcggcttacttgcaatccacaaaaagattaccgttgctgatgcatgaaccaagtccaccggaagccctgacatataaattgccagcagatttcgcttggtaattgcataggaggtcatcacaagggaagccgggttcatgattcctccatagataaacacggtcgctaaaaatccataaatacaaagcgaaatcttacgtgctttcaaccagcctttttgaaataaaatacctgccaaaaatccgataattccagcagcaaacatctgccacggagtccacggtccctgtccaaagagcatattcgaagaaagcatggaaagcgcaccaactaaaaagcccgattctgcaccaaagcagacggctgaaataatggtcacagccacaaccggtttaaagcttggcaccataaaaaatgctgcacggcctgcaactgcaattgcaaccaaaaccgcaattgtaagcagttctcttgcctgcggttttcttccttcaaaaatcaaaaagaacggcagcatgcagtaaactgcaatcgccagactgatgacaaaatattttcggtcatcaaaaagcgtaattccaatccagattgtaaccggaattaaaattaaaatcaaaaacatagatgcaatcgtacgttttgacagctttcccttgtgttttggcgctgtcagtacatcctgcgcttcccagaaatcgtttttttccggttctgatttctcatcccagaaatccaggtctgtttcctgtgccggtttcttcccatctaaaaaggcatccagaaagacatctaatttttcttctttcagcacgacaccgcctcctcttctgtctgattgattgcttttaccacatcctctactgttaccgcatttggaaaataatttcttgccatacggtttgcagcagtggtataaaagttatttccggcaaaaaattttttcgattcttcactggttaccacatttccctgaaagaacagtccggtacgatccgcatactgcgcacaaaattctacatcatgagaaatcatcaaaatcgttacaccatgttcacttaattttcttaatatctctccgagttcttttttataatgattatcgattcctttggtcggctcatccatcaaaagaattttcgggcgaagcagaagtacttttgcaagtgccagtctctgctgctctccaccacttaaatcatagggatgccggtctaaaagcccttctaatcttgttaacgagacaattccctcaactgcatcttttttcttcatttcaattggatatgcctcactttttctttcccgttttccatctatcacttcatataaatcctctcttacggttttcttcacgaacagactttgcggattttgcggcattactcctaagaacccatgatagaggtcatcatcactgtattttccgatttctttgccttccagatagattttaccacggtacggaaaacgaattcttgcaatcagactcatcgctgtactttttccggttccgtttcctcctaccactgcaaagatttctccttttttgatgtccaggcttaacccttttaccacatccggcaaatcccgttcatagcgaaaccagacatctttgattcggatttccggaatttctttttccggttcttttttcagacctgaaagttttccaaaaatagaattcttcttttttgctgtctcttcctgatttctttctttttttatttttataccttttgtctctaattcctctgacagccagcgtcgtccctgactaacggtaagcgggcatcgaagggaactgtttattccggcataaatctgcatcggtgccggcatggaaagaaacatatcatgtcccattgttcttaactgctccccaatttcattcggtgttccgtctgctatcatccttcctttatccatgacatatactttatctgcccatggaatgacatcttctaagcggtgttcggttaaaatcacagtagtcccgatatcacgattaattttccgaaccgtctctaaaaaatcggaagctgcaattgggtcaagttgggaagtcggttcatctaaaatcaaaagtttcgggtgcattgccataacagaagcaagatttaagagctgtttttgtcctcccgataattcactgacattttttaaaaaccaggaatggattccaaaataagaagccatctctgccacccgaagccgaatcgtaggcgtatcatagccaaggctttctaatccaaaagcaagttcatgccagactttatcggttacaatctgattatccggattttgaagcacatagccaatttctgcactttgtgtccgcaaatccacgtcttccagattctgcccgccgtataagatttctcccttcttttctccatgtgaagcaagcacacttttaaactgccgaagcagagtgctttttccgcatccactctttccacacagtacaacaaacgaaccttcttctacttccatggatacctgataaagtgccgcatggctttcttttggatattgaaaactaaagttttttacttcgatacaattcaattttttataacctgctttcttttatttttgacgctcacatcatttttttcgggtctgtcaaataccatggaagcctgcgctccatatctgccatttttttaagtttctcaaatcttctatcctcaagcacacctaaaatcacaggaaagaaacaaaatcccgcccatgccacataaataatgacgctaaggggggtcagcggaagtcctccgattttaatctgtgggtcgtactgtgcaaagctaatgcctgctgccattccaccaaaatacactcccatcagtgccagtaaagtgcctgttacaatcccatccctattatcaaatcgaaagattgcaaaagcgcttctcccttttaagccatatcctcttgcacgcatcgaatctgaggtatcaatcgcattttccagtgcccaggtaaccaatacagaaaaaatcgtaataccgtgacgcattttcttaaaaatgtttccgttctttacatctctcccaattgctttttgtccatttcggatgacggtcagctgctgtccaaatctcggcacaaaccgaaataccatagataataccaaagaaagtgccggaatcacacgaccaaacagatacacaaatttatctgttgtcatcactttgttgtaacaggaaaaccatagaatcgaaataaaaagcatcgatgccagtaccagtccatatacaattgcctctagcgtaaccggcccggtttttaaataaaatagcatcgtcactccataatgattaaaagcaggattaataaatgccacaattatcattgccggaagtgttgcaagcagattaaattttaatactctctgccagccttgaagtctggatgcataacaaaatgctcccaggaacgaaattcccagaaaaaccggatggctgttcaacattgttatcaaaatgactgctgcaaaccagaaaaagttcaccgccggatgacaatctgaaaaagcatcccctcttttttctttcatcttttgccctcttttcatttttattttcaaaaaactgctttcaaaatcaatgaaaataaaaatttatcgtacaaaaaatttgtttccgtctatgcctgcggaaacaaattttgtgttttaatctccaaatgcctgtatcctggctcgcagttctaacctacttgctgcccttctcagaagaaatttcttccaatggattcgcagttttcgtcctgattacagtagggataaagtctgttgcggaatctcaccgcacgttccgaaaatcatccgattttcatgcatttgtactatcgattcatttattttatttcattgttttgttgaattttgtcatatttctttcatagtacgctttatcatagagtttgtcaagcggtctttctttccccaaatttccggttatcgctttgattatcctaccagcgttccatcctcgtattttccatctttaaacgcgaagaaaaattcaaagaaatcatcggtttcataaatttccattagttcattcaaattccaaattggatttaaagatgaaagtttttcccgttctacccagaacaccttcccctcttccgaacttttcaattctcctgtaaattcatccgtcttatataaaagtacaagataccttgtcccatcctcccgaatccagtcttttatcccgcaaagctttggatttgaaatgataagaccggtttcttctctcatctcacgaataacggaatccttaagagattctcccggctctacatgcccacccggaaagataattcccttctcattttctccgagtattttttcctctaccagaacacgtcccttctcatcatagagcatacacatgttggctaattccattggttggcttctatccattgcattttcctccatttttgcagatttctatcaaaaaatataccatatcaagtatctcttttctacatcatttttacttttttgtatatctctttctccatctgcatatactatcagaaaccttagatactgcgaggattttattatgactttaaaaacaaatatttatcggtttctttttatttccattctcggcactctgcttcattttacttacgaatggtcacaaaacaatgccattgtcgggcttttttctgccgtaaatgaatctacctgggaacatttaaaattattattctttcccatgttttttctgactctttttgagctttttttctttcgagataggcttcccaaaaactttttacaggtccgaacctgtggaatctttcttggcatggggctaattgtagttgtcttttatactctgcttggtgtgattggaacatccattgattttctaaatatcgcactgttttttgttgctgttttcttcgctttatggagcgaaaataagcagtatagaaattcggaatcaaagaaagaaacttcttctaccgcattttctatcctgcttatctttaccctgctatttttcgtgtttacctttttaccacctgatattggactgttttgggagattacaaaagtttgctaacttctatttctttctactttctttctactttctttcgatacttcccaatcctcttcatcatctcgtcaaaatctatcggtttcgacaagtgctcattcattccgcttttcttacttgccgcaatatcatccgaaaaagcatttgccgataccgcaaagattggaatctctctggcatcttttcgctccattttccggattgcttctgccgcttcatatccattcattcttggcatcatgatatccatcaaaatcaaatcgaattccccaatttctgattttgcaaataactcaactgcctctgttccgtcttttgccggagtgaccaaaactccttgttcttccagcatataagtctctatttcaagatttaattcattatcttcggtcaccaaaatatgcattcccgaaatagaaatctcttcttccctcttctgaacttcttctttttcagcttcataggttttgtcaatttttaaggtaagctccacagtaaacaccgtaccttttccctcttcactgacaaaatctacttttcctccaagcagatccacggtcttctttacgatagaaagcccaaccccgcttccattataagtggttctcgcagtcttatgttcctgtgcaaaaatttcaaatgcatgtttttgaaattctttactcattccaattccggtatcccgacagataaataaaattcttgcacattctccatcggattccatctcccgacaggaaacctgcacaagccctcccgggtgattatattttactgcattgctcatcaggttctgaaacactctttggatgtttagagggcttccaagcagatagcaatgttcattttcaaccggctcataccgaaattcaactcctgcatttttcgcctgcacgaatacaattgttaccgcattgtctaaaatttccttcaaattaaatgactcatttttactttccatttccccggcttccattttactcatatccaatatgttatttaccaattctaaaaggaaatccgaggcggtataaatcttttcaaaacagtctttcatgcgagaaggctcttttacacattccagtccaatctctgccattccgcggattccgttaatcggtgtccgaatatcatgactcattcgacgaaggaaatctgtcttcgaggcatctgcggttgccgctttttctgcactgatacgaagctgttcctgataatccatctcctttttcttttgttcactgacatttcttataagaagcaacaccgatgtctgtccattttcatcatcacgttttttagaaactaatagcatctggtaccattttccggtaattgcttcaatcgtacaacctaaaaagttgcgctctttcattctttctgaaagtgttgttaagtctgtaaattccaaaaaagtctctcttgccgattcaagcatcagtttccgcgcaaattctgtaagcatcttatcggcttctttaattccggtaattatttcttttaattgcgaagtttcaacaaccggctcccaggtattttcttttggatacaggattaaattcacatcataaatacttgaaattgcctgaaccaaataaaattctttctccatccgattcattttttctctcttctgagactggacaaacaataatacaaccagagcaaaaatcagatacacacctgctgcaatgccaagcgtcagtaacatcctcggataaattttctgagcacggaaaaacacatacagataatagtttcggtacatatcatgttttccaaaccaagtttttccctcactttttaattcaatcagattttcatcctctggagtttggtcgttctttaaaacacttgaaatcggacactcagaaatcgaaagtccttccagttttcccgcactgctgctgattacattttctccatctgtcacaacaagcacttcatttttattctgcacaagattatctaacagattactaagtgagatttcgtacttatcatcttgaaacttcgttgtatcgtaataacagataatgattccagactcatcaactcttgaggcaatagcatattcataactctttccatctacttccacactgtcagcaaaaactttttccggaaactgtaagacttcttttacctgagaatcctctaaaataagttttaaaaatgtctcattttctgctttatctaattttacattttctgccacctgcaaattttcatctaataaaatcactccggaaagatactggttttcggcctgctctaacagttctgctttttcttcctcttttatataatatttcagcacattgattttattaatcatatcctgtaaatctttagttgtaattcccatctcataatccagatatttttgacaggttgtttttgcaagatttaaggtgcttgatacttctctttcaattgcctttttctgatgcctgaatgaaagcccaagcgttaaaacaaatagaacaattcctcctaaaattagcccaagcagaatatacttttcactcggactgctccttcgctgtttctgtttggtcatcctccgctcctccatatacatttttttctacatctaacccatatttttctacaattttctccattgtcccgtccttgcgcatttccccaaatgcctcattaagtcttcggacggcatccgcatctccctcttttcgaaatgccactcccacagcttcacttcttagactcatatttaagaaacggtactctcccggatattcctccgtatacgtctgtaaagcgccctcatgtccaatgatggcatctacatatccttttcttaacgacgtaaatacttcaccaagttctcgaaaacaggtcaactgctctaatttaggaaaatttggattcatctgttttaagataatcttttctgaggtagaacctgcctgtactcccacacgcttctcttctaaatcagcaagcgattgtatcgtactatccgaacgaactccaaccacacgctgtgtataaagataaggatttgtccataaatatcggttttctcttccctctattgtcagataagaccacagacaatccaccttcttattttccagttctacaaaacgatcttcaatcggtatcatctgaaaaacaggtgtatatcccgctcttttacacgcctcctttgccacatccacatcgattcccgaataatttccattaatatcctgataaaaataaggagtatacgaagttcctccaattatcagtcctggaaaaactgcctcttttttttgttttgttccacacgcacagacacctaaaatcaccgcaagtgccactacaagtaataccccttttttcctcatagctgttcccctttttacttactccagaatttcttatgtcactattaattttttatattttcctcacagatacgtgtcagcttttctttaaaaaatgaaatcatcctctcccatacttcatcctgaaagaactgtaaatccgcatggtctgctccttccagagctaaaaatgtcacatcacaaccatttttttctaagctttcataaagactttcactttgtgaaaacggcacagtacgatcatttgttccatgaataattaaaaacggtggtgcttcttttgtcacttttgaaaccggtgaattttcatatcctttttctggatttttcatgacattaaagcccagcaacagggattccggtgatgctgcacactgttctgcctcttggtattgaaacttcgaggtatcagttggaggataccatgggcaggcagcctgaaccttgcttgactgttccagataatctccaacatccagtgaaacatcttcatcaagtgccgccatacaagttaagtaaccacctgcggattctccagtcaccccaatatattctgcatcaattcgataccggtctgcatgcgctctcaaatagcgaattgccgcttttacatcctgaatctgcattggatactctccctcattggaggttcgatactctacacttgccactacaaatccgctctgtgcaagcttgctaagataggataaatgcgctgacttatccatgcgaagccatgccccgccacaaatccagactacacaaggatatgtttttccactaaaatcctccggataaatcaaatccagttttaaatctctgcggcagtgcccataccaggaatccacctgtgcatacgtgattcccgtaattgtcacatactgcggtttttccaccttaatttttaatacttctttcattcgttttcctccgatcacctttttcctttattttatcataccctttgtcaaaaaaaaagaatcctgggaggacaggattcttttttcgggtattctatgctttatcgttttcttatttttatttctgtctgtttagaaaattctcttttccgaaacaaacttctgagcagtaccatccacccccacgaaatagaaagtgccggaagtgcggagattatgattcctctgaccggagagatttctgaaaacacagttggtccaaaaaacctgataaacacaactgtcatcatgacaatcaatgtaattttctctttcatggtattcgggggtgtcaggaaaatttttttaaatccatctcaagtctttctggttcttttttcattttaaacaaggcgtacctttaaaatcggcagaaacgaaattttcgcttctgccggtttttgtttaatcttctttaatttttccgtcaattgtaatcgtcacaacctgccatggaatgaatttttcactgttttttaaggctgccaccgctgcccgttccaggcctccgcagcaaggaacttccatacgaagcaccgtcacacttttaatgttattttcagcaataatccgggtcagtttctcactatactctacggaatccagttttggacagccaatcaatgtaatttttcctttcataaattcctgatgaaaattcgcataagcataagccgtacaatctgccgcaattaaaagttttgctccatcaaaataaggcgcattgaccggcactaacttaatctggcatggccactgaccaagctgggactgctggacttctttgacagtttcttctttttttatactttcttctctgttgaattgatgcagggcatgtcctgggcatccggaaactgccggtttttctgatttttcttccttgtctttactttcctgcgcttttcttttcatattttcttttactgctgtttcgtcataagcggctgcttctctttctacaaatgtaattgctccggttggacaatttggcagacagtctccaaacccatcgcagtaatcatctctggtcagcttcgcctttccgtcaatcatctcaattgccccctcatgacaggctgatgcacatgccccacatccattacatttttcttcatttatctcaataattttacgaaccatagaaaaatacctccgtttgttttagctctgtcttgtttacaaacacatagtaaaacaaatggaggcaaaattatgttgttggtacaacaaatttaaaaatcttatttttaattctgcagcatttggatttccgtttcaaaaaaacgttcctgaaattccaccagtgctgcaatctgctctttgctgtatttgcctttttccttacagacaaccagcttgtcttccacgtcattttttcgtttaatcactgccacgacatatccctcataagcttccacagcttcaaattctccgacaacataagcatcgatttcctctccatctccagatacggtatctggaatgaaaccatagtttaagcaatatacaaatccgtgctctggatgtcttgaagcaaggggacggtcgattttcacctttataaactttccaaggtaagattccagtgaaagtgttgtgtttatatctctgttcttcatttacatttcttctttctattcttcagctcacatcggagttcccacttcaattagatttccatccaaatcatagaatcgaacaatctttttcccgaaatcattctccatcagcttgttgacatattctacttccggatacaactgctctagtttttctacaaacttttctatatcacgttcctcgaaatacaactcactggcatgatttttttgtttcacttcttttttcaaaaaatcctgccagatttttttctgctgtaatacaagtccttctgttaagattacggtctcgttgttatccagaacaacttccagaccaaaaaggtcgtgataaaagtgtttggatttatcaatatctgttacaataattaatacgttttttaatctcatggactctcctttccgcagccatagccaacataaagaactacttcgttttcatctttcaacaaagtttctgcaacctgaaacagcaacacaattaatattaatgcttctttcacgttaatcttattataacagatattgtcatttccgtgtaaaaaacagtctttggcaaacattcttttgagatttttatatgaatatgatagactactaactgtaatatatattggatttcttactaagaaatacttacaaaagaaaggcttttttattatttatgaaagaaaagatatttaacatcattcagattggagataaaagcaataaaatcagtcgtgcatttgatatttttattacgattatcattgtcggtaatattattgtcacttttttggaaacgtttgaccagttatcctctttttccggtttatttaaaatagtggagattgtcactgtttttgttttctgtgttgaatacatcctgcgcatctggactgcaaactatctttacccagaagtaactgccggacatgcacgttttaaattcttgatttcttttgatggaattgttgatttgctgaccatcattccggcttttttcttatccggttttgtcattttccgtatgctccgcgttgccagaatttttcatctgtttcgtctcaatgcaaagtatgattcatttaatgtcatcacaacggttctttatgaaaaacgaaaccagattatttcttcggtttttattgttttgattttaatgctcgcaagcagtctgtgtatgtacagtgtggaacatgaagcacaacctgccgtctttcgcaatgcctttagcggaatctggtggagcatgtcaactctgctcaccgtcggatacggtgatatttatccgattacaacccttggacgtatcatggcaatctgtatcgcctatcttggtgtcggagcagtcgctattccaaccggtatcatcagcgccggtttcgtagagcagtaccagagaaaaagcagtatttctgatttaaaagatgcggacattcaggaaattgcagaagtgtttgttgataaacgctatgccggaaaaactgtagaagaaatggaagaggcacagcaaatcaccatctttcttgttttacgtgatgatttttctgtgcttcctcaaaaaaatacggttttaaaattaaatgatattattattattcgggtggaaggggagtagtcagggatgaaactttcgtccctgattatttatccttgtttataagctcacaatcttacactcaaacggtgcaagcgtgatttctccctgtttcacttcatgcgcattatggttaatatacataaccactttctgtgtctcatttcctctggttacgatttccactccttcttcagaaggtgtcatcttgatttcacattctttcataatgtgttccatcaaaagattggtaatcttttcttccagaccgcatcctacatagtaagtcgttccattttcggtcttctttctggtaattgccgcaaattcttcatagaactggtcgccataatggaataacacttctgcatctttggtctgaatcatatctctgaaaattccgccttttccggaaattccttcaaattcaccagttccgattaccggaaatgcctcataatcctgaagactttcagtttcttctatagtaagaccggttaagtctccataatgaaccggcatcgtttcaccaaatggaatattattgtccacatcttttactgcatgacggtaagtaactaccactgttccgccattttttacaaattcatggatacgtttttccatctccggttttgtaataatcatctgtggcaaaatcactactttatagtcagaaaaatctctgtcttccggaatcacatccacaccgacattctgatcatggaatgatttatagaatttctgcatttctaccgaactgtctaacaaaatgctctgtctctggattctgaaagatgccagtgaatcatagtcatatacaattgcaacctgattgttaatcggggcttccattgcttctttataattggaaatatcccggaagaaactctgtacttcatagaattttctacgctttacattatctgcatcaatgactccataacagaactgttctgcaccttttgttgcacctcgatatctaaaatacattaaggaatctgcaccatgcgccatactctgataggaccacatttttgcctgattcggtctcggaagaaaacctgtgacatcatgaccctgagctcccataatggcttctgtaatccagaaattttccccttttaagcctctgatataatccagtccaaatgcaatttcatgaggttgaattggctctttctgacctccccacaccggataattattataggctacctggttcagactttttgctacttttgaataatccacatgttttcctaatcctccacctggaaaatcatgcatgacaactgcatccggtatgatttctcttacaagatttgcctgaaactccatgaaatccacaatcgactgactgcggaatctctcccagtcctgtctcaaagccggattatgcgttgtaatcgtctccatagggattggaatttctgagaaatcattgtattcctgtgaccagaaagtagttccataagtttcatttaaccggtcgatatttcctgcaaatttttcagaaagataactttggaattttttctgacagtttttacaataacatacatcactgccttcatgaccaatctcattatcaatctgccacgctacaatactcgtttcctctttataatgttctactagtttccgaacgattttctcagaatattcatacatccgtggactattgaaacaatacacatgtcttccaccaaaagttctcttttttccaccctcaaattcagaaacaatatccggatattttgctgcgagccatgctggaattgtagccgtcggtgttcccataataatttttaaatttcgttcttttgctttttctattacatggtcaaaaaaagaaaaatcatactgcccttctcttttctccatcaaatgccaggaaaattcagcaattcgaatcacattacagcccagctctacaattgtatccaaatcctgttccagcatatcagcatgccattgttccggataataatctactcctagccacataatttttcctccctaattttcatataatatcggattctttcctgcacttgcttttgtaagtgcgaaagtgcattttctaactatatggtagcaaataaatttttacctgtcaatgaatttttactaaatttatttatttttatagtaaattttttacttgccattattttcctgctttttgatgcttccacgaataaccagactacatggaatgacaattttccttggaagtttctctgcattccagaatctctcaagtgcaaatgtcgcttcttttgcactttcttttaaataaacctctatggaatcaagtggcggtgtactgctctcagaaaaggttgtattattataagttacgatattacaatccccaggaaccaggaagccatgttcacgaatagctttcaaaatacctgctgctgtagcatcactggaaataaaaagtgccttgggaggttttttatttttttctaaatagcgttccatcgcctcataagaacttccggaattcatctcacagtcaatcaccagattttcatcaaacagatttctgttaatcatcgaatttttataataataaaatcttggatccatcgtaagcattttcaccctgttatacgtataaactgcacctgcataggcaactctctcatatcccatctcatcaaaatgattgagcaccagacgtattgccatatgatagtttggaacaatactgtaatacttcatctcatccggcgaggaatcaataaatacaatattggatgtatacttttcaaaactgtgaatttcttctgttgtaaaacgtcctattgccactattccctctaaatttccatcactgtttttcacaaaattcccatcactgtttcgatataaacttactgtattccagccattagaaaagcactctgcttctaccatattttttaacatcatgtaataaatatcatcctgaagctgttgcatttcaaacatctgtgcaattcctaccgtaatgtttttgctgtttttaatcttttcctgatttcgaaccctagtatccttgtgcctttgagatactgagcgatatcccaactccactgcaattttcgtcactttctctcttgtttctgccgctacattcaaagtactgtcgccatttaaaattcttgataccgtcccctgagatacgccggcttttaatgcaatatcttttaatgttgccataagttccccttccacaatatttaaatttttactaaaaatctattaaaaacagtttatcacaagaactgctgtaatgcaaaaaaaccgactgaataagccggttcttttgcgtttttattctaactatttttctttctttttatccgtatttacttttttcaaaatttcttccagataagcgccatccagcttatatccttttgcatagattacaaatgcaagcactgtaatgatggtcggaatcactcccataagaactctcattcccatgatagtcgatgcagactgttctgcatttgcaacatatcctacaattgtaagacccacaccgatgaaccatgcagaaacagcagatgcggtcttaacaagtaatgtctggaaggaagcaataatactttcatttctgcttccaagtttcacttcaccataatcaatgacatcggctaacataacggttgtcgcacctaatgtcagacccgatcccattttgtaaagtacaccgcagactgcaataattactacattttgcggagcaaagaatccgctgataaccaatcctgcaagaccaattgccggactgaaacttgcgattgcaaatacctgttttttgctcaaatcttttgaaatcattgggaaaataaacagtgccgcaatttccgcaaattgagaagccgttgtgaagattggatacaagctgttgcttcctgctacatatttaaagtaataaattgcaataccacctgcaagctgaacaaccagattgtagcaaagtacaacaccgataaatacttttaactgatcatttccaaggataacatgaattgcatctttaattgttgttctttctgactttttatctgttgtttcataacaactgcggtcttttacaaaaacaactgtaataacagaagtcagtacaaagattacagcaattccaattgccagataaaaatatccttttgcatcatcgccttttcccagcatggaaaccagtttgattgcaaatgctcccattaacagccatgcaagactggcaaaaattctcggaattacagacatggaatctctctcttcttttgtacttgaaagagaaggaagcatagaccaatatgggatatcaataatggtataagacattccccaaaggatatatatcactgaaaaataagcatacatcgcagttcctgtcattccagccggtttgtggaacaagaaaataagaataatggagtttaccactgctccaattaaaatccatggtctgaatttaccccattttgttttagtgttatcaacaacaaatcccatcatcgggtcattaaatgcatcccagattctggccaccagaaacaggttaccgacaaacaaaggtgtcagtcctacagtatctgtgaaataaatcatcagaaaataagaaatgatggcatagcacaagtcttttccaagtgcaccgataccaaatgaaaatttactaaaatttgttaacttcatatgtgttctccctcgtaagttttattacttttatcattctccaatgtaaagaagcaggggaatgcttatctgcagtaaagcggacattcgcaatccgcttcgctacttgctcatgaacgcagtcgctttgcgatctgtcagtgggagctttcaactcccactgacagaagcattcccctcacccgccgcttagtgctctgcgcacttgaagcggtggaatgcttatctgcgttcaatttctttaaattggattaatgtacttgcataatctcctgtcagacaaaggtcaaaaccgtgctgcatcagatatgcaccactctttttaatttcttttgtttcaagaataacagaatataccgcctcttttttcaagcctcttaattttacagtcactttgcggtgtccgattttggtctgaggaaggaatgcgaaaaccagtccttctgcctcttttgtatattcataaagatgatagtcattttcagaagtattttgcagacggtagaaatctccttcctgaatgattggtctgattttcttataaagtgcaatcatttcttttgacagattgctatcttcctctgtaaatttcaaaatattacagccaattccgagtgttcccatcattgcactgtggaaacggaatttcatagaaatcacacgatttgaaataaaattcggacaatctgttacccaggcacgcattgccttgattggataaatataagaataactgtcctgaacagtcagacgatcataagcgtctgtgttatcactggtccagaaatcatcaaaaatcccaaggattccataatcaattcttccgccaccagaagcacacgcttcaaataatacatttggatgcttttcttttagttttttcacaatatcatagactgcttcgatatgtcggtaccagatatctttgtgaagattggtctgtgaaattggtctgtttgcatcccatttgatataatcaatttcatgataagaaagcaggtcatctaacatttgataaacaaaattctgcacttccacttttgtcatatccagtacatactgacctcttgaagtatcactttctcttgtatcaaagtgataaatccaatctggatgttcagcataaagttttgttggtggatttaccatttccggctctacccagataccaaataaaagtcctaaagattttacttcttttattaattcatctataccatttgggaatttttcttcattgacataccagtctcccagaccattttcaatgccatttcgttctccaaaccatccatcatccacaacaaaaagttctgctccaagttcctgtgctctttttgcaagcttcttttgttcctcacaggtaacaccaaattctgttgcttcccaggaattatataaaactggacgaagcccagctcttaagataaagtcttttgcaaagttatgaagattatgagacattgtttcaaatccactatttgaataaccacaaataattgcaggacttgtgaatgtttctcctgcctgaagcttaagacaaaagtcgtgcgcatttaagcccagctgcaccaacgtctcaccatacggtgtctgctctaccactccactgaaatttccggttctgcgaagcgcaccaaaatatacatctccacttgtctccgttgcatctttatctaaaataaaatatggattatgattgtgagaagagattcctcttcgattttcaattaaaatctttccatagcttaccttctgtacaaacctttgctgctcagcgccccaatgaccatgcacatttgtaaaatttaagtcttcatacggaatatgaaactgtccactctgtaactgctcgacctccattgcctcattggattcattatgaagcactacaaaacgctccatcaaatcatacttttcatacactttataatgtaattctattttcaaagcataatattgatccttcagttcaagaatcagctcatcatatgcttctgttttttcaatttgatatcccacatactcatatacaacttctctggttccatctgcaaatgttactttcagacaatgctctttataacgcagacttccgtaaaccggaaattcttctggagtaatctcatagaccgggtcatttgtagatacctctgtcaacaccggcatttcaaagtcctcaactgcttcaattcgctttccccagtataagtgtctcactaagccctggtcgtcaattccaaacgcataactattcgaaactgtttgtaacaagaaaacattttttgaattgttgatcacaatactcatttgctcttccccacttcttttcttttaaagtatcactatttttcatttcagtaataaatttaccacatttttttactttaagtcaaactctttttaccattgctttagtaaaaatttatctatttattttgtgaaatttgcacaataaatattattttttttaataacaaaaaagacccctttcggagtcttttctcttaacttttaaaatagaagctgaagtcccatcacaatgttccacatatatgcacatgtcttttaatccatcatattccctgtcaagttctgaagtatccatgctgcttcctatctgcttacgaatttcccgagcaaactttgaattcttcacaaatttgcggataattccctcaactgccgcattaatcctgtcctcattccactgtcttttataagtacagcggtgtccgttcacaagctttctatgtttgaaggcatatttgatctgtcttccagttttttcctagtgaattgacaaatgcatagattccataatctacacctccacgattttaagctatcccgaaacatgagactattcgatcactttttaacaaaaaatcccgaagttaagtcaagcggatattcgcaatccgctttcgctacttgctcataaccaaatagctgctacgcagcttatcagaaagggcttaccccctcctgatacaagcaagtccccaccattgcttattgctttttacaattaaagcaggggacttccttgatttggttaaattgccatcatccagtttttttccaactctgtatcttcattttcttgttcctgtaaaattcggtaaattgttctccaatagtgtttttttacttcctgacagattttttcgcaatctccctctttacaagctgctaaaattgcaagatgattttcatactggcgctccaaaatctctcctttatctttcaataattcatagcctgccaaaagattactgaaatataactctttccatgctttttcaagacgcggaagttttgacattatcactaactgctcgtgaaatcgattatcatattcaaatactttgtcaaatttttcaattggaatatgtttcatatgctccaaaatactttccatttttcgaatcgtatctttcggtatttttccatttagcaaacgtatactgacgatttcataatttgtacgcaacaaataagcttcataagaatccataagagaaaaccttctcacagaacaccccacgtttcttgtatactctacaagcccctcaatttccaactggcgtagtgcctcacgaatcggtcctcgactggtatgaaattcctgtgccagctccagctccacgatccgctctccgggacgaatctgacgcttcatgattttcgttcgaatagcatttactacgctttctcttaatgttttgtataataattcactcatatatctcctcttaccacaaagtgttctatgtgaattcgttaccactgtaaaatttatcacaaagtattttacatgaattttctttcactgtaaagttttatcacaaaaacatcacatttttttgatgatcttcttaacgatttctacggataaatccattccttctaccgttatgtgctcaaatggaccatggaatccatctccaccggtaccaagattcggacatggcaaacctcggaaactcagacgcgcaccatctgtacctcctcgaatcggagaaacatccggttctactcctgcttctttgcaagctgcttttgcatactcaattaactgcatacatggctcaatcttttctctcatgttacgataagattcttcgatttttacctctgcggttccttctccgtaaatagcattgatttgcgctactgcctgacgtagtttctcctgttttacatcaaataataccggatcaaaatcacgaataatatatttcatcacagcctgctctacagtcccgttaaattccatcagatgataaaatccttcatatccttccgtcttttccggacactccgcttttggaagcattccgtgaagttccattgcaatggtctgcgcattcttcataatatcttttgcgcttcccggatgaacattcactccatgcacaatgacttccgcaccggctgcattaaagttttcaaactgaatctctccttcatggctaccatctaaagtataaccgtaaactgcgccaaattcggaaagtttcaggtaatctgctccgcctccgacttcttcatccggtgtaaacgcaatacagagttttccatgaggagttttttcttgcatcagttcttccactacggtaagaatctctgcaattccggccttatcatctgcgccaagcaatgaagtaccatctgttgtgattaacgttcttcctttataactgcttaatcttggaaaatcttttaccgtaagcacttttccagaagtaccaagttcgacatctttcccatcataattttcaatcagctgtggctttacatcacgtccattataatccggagctgtatccaagtgtgcgattaagccaagtgccggaactgcctccataccctcggtagcaggaagatagccatacacatatccatattcatccatttttacgtctgaaagtcccagtgctttcatctcttctacaagaagcgctccaagatccagttgtctttttgttgtcggaacactcttgctgttttcatcacttgcagtccaaactgcaatatattttaaaaaacgttcataagctttcatcttattttttcctcttcattttcaattcttattagaaaaatacagcccggagttcaatgtccgggctgtttcattatcataacaaatttttattactgatgggtatatccaaagaagaagtatcccagtggacagcaatataaacctttgatgccatctgccagcatgtatttctgagtatagaagtaaattggagctaatacactatcttcaccaaccagtttatcttctgcctgatgtaacagttccatacgtttgctggtatctgtttctgcttttgcttgtgcaatcaggctatcatagtcactgttagaatactgacaatcgttatttcctccgccagtcagccacatatccaggaaggacattggatcattgtagtcagcgatccagctgttacgtgcgatagaataatctccgtctttacgtgtctgcaggaatgcagcccattcctggttgtttaatgttacggttacaccaagttcattttcccacatagactgcagtgcttctgctactgctttgtgagcatcacttgtgttgtacagatattctacaaccgggaagccctcaccgttttcatatcctgcttcagcaagcagttttcttgcttcttcacagttcgcttcatagtctgcatctgtaggtttataataatctccaccaactgtacggaagtcatctccgtcagtgccttctgcgtcatagataccagccggaacgaatccacctgcttctacctgtccggactgtgttacctggtttacaatataagtacggtcaattgccagagagaatgctttacgaactttcggatcgttaaatggctctttctctgtctggaaacatacataataagttccgatatagtctacgatcttcatatcgccggaagcgatcaaacttgtaatttctgcctgaggcgcatcctggatgaaatctaattcgccggatttaaatccggataacattgcgttctggttgtccattaatttgaaagtaatggtttccggtcccagattttcaaaatcatagtagttttcgttcttttctactacgatctgagagttgtgtgtccactctttcattttgtaagcaccgttagatatataagtatcaacgttgaatgtccactgatctccgcctttttcgatcatgtcctgacgtaccggcatcatagcagggaacgcacataattcttcaaagtaaggtaaatcatttactaaagttacttcaaatgttttgtcatctactgctttaacagccagttcatctgctgatttgttaccatcgataatatcctgtgcatttacaacacagtctaacatataactgtagtctgctgcggtttctgggtttaccagacgtttccatgcatattcaaaatcatttgctgttacatcctgtccatcggaccatttgattccatcacgaagtttaaatgtataggttacagttccgtcatcatttgctactttttcatagctttctgcctgtccaggaaccagtgcagcactgtttgcagtaccatcagaaccatttgtttcttttccactgtcttcccatttcatcagaccttcaaataagtgatgagccattgttccggcatctaaagaagtacttaatgtcggatccattgtctgtggctcagaagccaggtttactgtgatgttaaactctccatcacttgcggtgtcctttttccctgcgtcgtctgccgcatcttctttcttagctgcaccgtcatccgttgctgtactgcttccgcagcctgcaagcatagatactgtaaatgttgcagctaacaggatagataaaacttttttcttcatatcctctctccttttcttcttttattgataaacaggaactcctgcattatccatgtaagaacagctcgtttccccgtgttacttactgttccaaaaggtggcatgccacccagtgttctttttcatactctttaaatctcggcacctcttgcttacatctctctgtagcatatgggcagcgagtatggaaacgacagccacttggaggattcattggagatggaatatcaccttctaatacaattcgctgtcgatttttgctcacctgcggatccggaaccggaactgctgaaagcaaagttttcgtatatggatgtaacggattacggttcaactcataactttctgcaagctctaccattgttccaagatacataacaccaatacgatgtgaaatatgtcttacaaccgataagtcatgcgcaatgaacaaataggtcaatcccaattcctgctgcatatcttccagcatattaacaacctgagactgaatggatacgtccaatgcggaaatcggttcatcacatacaataaattccggatttacagccagcgcacgggcaatacctacacgctgctgctgtccaccggagaactcatgtggataacgattcgcatgctcagtgtttaagcctacatggctaagtaactctttgattctatcggttcgatctttttgattcggacatagcttgtgaatgtccaatgcttcaccgataatttctccaactgtcatacgtggatccaagctggcagatggatcctggaaaatgatctgcatcttccgacgatatggaagcatatttacctgttttgcttttggaactttcaccggatgaagaattccattttcatctcttttccaaggatcttgtccttcaaaaatcgtctctccatcatatacaatttttccggaagtcggattatataactgtaatacggtacgaccaaatgttgtttttccacaaccggattcgcctaccagaccaagtgtctctcctctttttacttcaatggagatatcttctacagcctgcactccaggtcctttaacacctttgattgggaaatattttttcaggtgctcaacctgaacaagagtatcttttttctcactcatggttgtctgcctccattttttcattattattttttgctgcttctttttgtgctttaatctgctcctgtacgcacagccaacatgctgatctgtgattttctcctaattctacatatggcggcattttctgtaagcaaattttcatcgcactttcacaacgaggtgcaaacggacatccttccggcgggtttaacatatcgattggtgttccctcaattggaatcaatcgctcatagctatccgcatcgacacgaggcatagagcgaagcagtcctctggtataaggatgacccggcgcatagaaaatatcatctaccggtccctgctctacaatcttacctgcatacataacagatactttgtcacagatttctgctacaacaccaaggttatgggtaataaaaataatacccattcggtttgttttctgaagttttttcattaactccagaatctgcgcctgaattgtcacatcaagcgctgtagtcggttcatccgcaatcagaagctttggatgacaaatcaaccccattgcgatcataacacgctgacgcataccaccggaaagttcatgcggatactgcttcatacgtttttctacattgttgataccaacttcttccagcatttccatcgcacgtttctgtgcttcttctttgctgatatttttatcatgcgcttttaaagcctccatcagctgatttccaatcgtatagaccggattcaagcaggtcattggattctggaaaatcattgctacttcgcttccacggaaatttaccatttctgccggagtttttgccaatacgtcctgaccttcaaatgtaatagagccaccgattacttttcccggattttgtaacaatccaatgatagaatatgcttccacactctttccggatccggattcccctaccacacccattacttcattataatctaaatcataactgattccatttactgcttttacctctcctgccggagtgaagaaagaaacctggagatctctgacttctaacagcttgtcagttttattattctgttccattacgtctctccctttcttattttttcagtttcggatctaatgcatcacgcagaccgtcaccaaacaggttcaaagacaggatcataacacttaagatcactgccggaatgagcagtcggtacggataggtgcttaatccgcttaatgcttcggaacacatggaacccagactggtaagcggagcagatacaccaacacccaggaaagataagaaagattccaggaaaattgcggatggaatctgcaagaaggttgttgtaacaatctgtccgatacagttcggaagcagatgtttactgatgatacgtccaccttttgcgcccagcgctcttgctgcagttacatattcctgctgttttaactgtaaaatctgaccacggataatacggctcatggttacccaatataacagaccaaatgcaataaacatagaaatcaggttcggtccaagtaaagttaccagacgctgtaaaacaccatcaccagaattctggaactgttccagagccggttttaaagttgcagagagcaacaagataatcagcatctccggaatagagtaaataatttctacaattcgctgcataacactatcgactacaccaccgcagtaaccggaaatggatccgtaaattgcaccaatgatcaatactaagattgctgcacaaatacctacgataatggatactctggcaccaaccataacacgcaccataatatcacgaccctgatcatcggtaccaaacacatgagggaatactttctctccggctgctttcttttctaattctgcattcgaatatccaaacatactatgtttgattttcagtgcttttgctgcatcttcttctgtcacttcttcactttcagcttcctgctgagatacatttgcttttgcacgaatttttgcttcatccacacgagataaggtttcacctttggcttctgcctctttacgtgctttttctactgcttcatccggtgtcaggtttcctgcaccgttatgttcttccatataagcattgattttttctgttctttcaggctgtaatgccaaggatgcaacgcttcagaaccacgaatctgctgtttataagtatatggtacaatagatggtcctacaaacgcaaaaagcgccagcaggataataattaccaatgcaaccattgcaacggtatttttacgaagacgtctccatgcatctttccaataagacacacttttgcgttcctgaataaaattctctttctcttcagaggttgccggttcaaacgcatctgccggcaaatcattccactggaggatatcctcaatattcggctgaagagaacctggtttatgatatcttttcttttcagacattaccttaatttcctccctttgccagattgatacgcggatcgaccagtttataacatatgtctacgagcaagttcatgatgataataaatgctgccaggaaaatagttgttcccataattaacggatagtcacgattctgaattgcctgtacaaaatatcttcccagtcccggaatagagaatacggtctctacaaccaaaccgccgcaaagtgtaaatgcgatctgtggtcccaaataagtaataaccggaattaatgcattacgtaatgcatgtttgaaaataattttactattcttcaaaccttttgctcttgctgttttaatatactcctgattgattgcatccagcatagatgttctggtctgtctggacaaatagcacatcggataaaaaccaagggctacacacggcaacacataactttgcggagtaccatcaaacaacgccgggaaaactttgattccctcaacaccaccacagaatgtatgtaataataaagttgcaactacaaaccccggcatggaaataccgatagtacacagcactcgcagaaaactgtcaatccaggttcctctcttaaatgctgcaagacatcccagcggaatgcctaaaagcactgcccataaaagagcaaggctacctacttttgcagataccgggaacatttctttgataattcccagaaccggacggttcttctgcatcttgatggaagttccaaaatctccctgtgccaagtttttcagatacttgcccagctgaacatacataggctgatccagtccgtattttgcattcaatgcctggattgtcgcctcagacggtgttttttctgataaccatggattacccggaatcgcattcatcaaaaagaacgtaatacaagcaacaagcagcaatgtaacaaatgccatacagattcttcgtattgtgtattttgtcatcttctatacctttcctctctttctcatctctcctgtcgatgtaaagcggacattcgcaatccgctttgctacttgctcatgaacgcagataagcattcccccacttcaagtgcgcagagcactaagcggcgggtaagggggatgcttatctgcgttcaaattgtaaattgtcgacaatatgacaatattatacccattttaacgcattaatgtcaagataaaacaactatttttatattttctctcccacacaattgtgcgtatattatggacatttacgttttataatctcatacggctcgctataccagatttttggctcatctgcttcatttttttctaaaactttcctcattaagccatctattttttccacctgatcttctacattattatccactgtcccatagatttcgccacttaaatccacccctgcatctctcgaatataaaatgcgatatgataagacaatctctcttccggcgtctttaattcatttcccaaaatttttttaatatttccaatccgatataatacggtattacgatgtgtatacatttcagaggctaccgcctgaatgctcccattgtgttttagatacgcgtgcaatgtttccacataatttgcatggtatctgcggtcatgttcttctaatgctgccagacattccgcttccaattcttttaatatccctttgtcctctaccatatacagtaatcgaaataaaccacattcatcaaattttattactcgttttttttgcacgatcgccatatgcgctgctacctttgccctatgatagcttaccgaaagtttggaaatatccatacacctgcttccgactcccacgcacagtttgagctccggcatacgcctctctcctctttttatagctccttctattaattggtacaaaaattcttccggaaccgcatttgctactaatacaaaatctgaattgtaataaaagaaactggcattatgtgtaatatcttccagatacacttgtattcgataagacaacttctttctctctacggtatccatagcatccaacccttcgcaagtcaataaaaacacctgaaagcttccatctacatcaaaatgttgtaataattcttttcgatattcattctgcttctccggagtctctattaccttaattaaagcggaagcaatctgctcatcggtgttatcctgcaaaaatacatgaatactaaagtcttttatcatatcggataagtggacttcccaaggtaccgtcaataatggaagatcattttcgtcacagtatgcaatcaattcttttggcacttcttcaatatactgccccacattaataatcaaaccagaggcatgaaactggttcagctgccttgccaaatgcatccagtcttctttttggggaaatcccaacccggttgtcactgcaagctcctttccccaaaaattttgtataatcgttgttccctccagaagatgtacccaactgatggaattcgcccagccattttttccagccaaaaatttcatttcatatcgcttttctgcgatcaatatcatatcttctattgtaaaactcatatacgctgttacatcccttcgtcttttttatatttttttattgtaacatagtttttgtgctgtcagcacagatttccactccaatttttagagttatccgccatagcttttctccatgtttgtgctaaaatatagataaattaaaaaatgtttaaaggaggcataattatgagatttgaagtttatacaaattcccaggatacaattcttccggaatggattcagaccgagcgttatatgtattgtgacaattttgtaaacgactatatgaaatctaatcgttttagtcttctttcttttgtcagacatctgtttcacagataatcatatacctctctttttgaaaaaaaggacatccgattcgggtgtcctttcttcttttggatgctttttttctacatccgacagttttctatttatctaaaactgcaacctgaattgcctttactgcctcctccatgtatttgacatcttcctcacatagcttaatatccagacattttacggtatcttctacactggaagcttttcgcattccaaccagaagactcattctgtcatactgagacagtgcccaggattctactaatgccgcaaaactgcaattgtatttttcacaaagcaatctccaagtttcaaaagctctgcgcaacccctccttcttctccggagctgtccaaggtattctggatcggatgtcagtttttgcaaattcacgttccataaagaccggagaagttaagaatccttcctccagtacaccataagtttgaaataccgtattatactttttacacagttcaaaatattctctgccatggaaaggagagagaatactgaaaaattcttgcacaacagatactcttccaccagcttcctgatatgcagccaaatccgccggctgactgttagaaagtccataggtgcggatttttccttcacgaaccaggtcttccaaagctccaaccgtctcctctacaggaaaactgctgcaaacataatgtacaataatagagtccagataatccgtttccattcttcgcagcgaatcctcaacatcttttttcacagctgctgctcgggtgtcattatttacggtataaccgtctcgttcgtaatggaaattaccaccctcatctctccaattcaatgagcatttggtctgcaaaataaaatcttctcttcttcccttaagcgccttaccaagcagttcctcacttacgcctgtgccatacaccggtgcggtatcgatgtaattcacgccatattcatggcaaacgtcaagcagacgcttcgcatcctcaactgtagaatctttatctgtccaaacacttccgcccccaagtccccaagtacctaatgcaaccacagaaacatcgatatccgtgttgccaagcttttgaaatttcattgtaattcctccgtttttgttgttttctatgctattgagtaaaaactattaagtctatccaaaagttattttctatattttttgtagacaacagaccgtttcgactgtgttttcgttgagcaaccgaattgcttcgccttcaaaaccttcatattatttcttcaatcgtcatctcatatacttctgttacttttttcattgcttctgatatccccggctgctctccggtcctatctctcaaaagttctgttaactcgttactaacctcatacagacggtcaaaagaaagattctggcaaacccctttcagtgtgtgtgcaccgcagaaagcatcttcaaaatttttattttccaatgcctgttttaactgtagataactctggtcttcaaggaactttaatgtaaatctctgaatcagtgcttcgctgtgaaggcgccccaggacagcttcatagtttcctccaatagcttcatagcactctcgcattgtcatattttagtcctcctgtcaattgtattccactaattcatgaacctctgctagtcaattatatacataccttaaaatcgtttttataacttcatcaatcacaatcggctttgacaaatgtgcgttcattcctgcatccagtgatgcctgaacatcttctgcaaatgaattagctgtcattgctataataggaatgttttttccatccggtctgtcattcatcgccctgattgcttttgccgcttcataacccttcatttcaggcatcatgatatccatcaggattacatcaaatgtgccttccggatgaaatccgcaaactctttatctcgtgagcttccgttcaaaagtgctacacgcataccattgtaagtactgtaatcgccatccacaatcgtgctgttgtcactgcggacggtcagcatcccataattggttccgatcggacgtgaaaaatcaaacttttcttctctgtccggtgttttgcgggcagatgttaccatatcaatctcgccatcttcaagcatctgctgcatatcatcccagctctgatcgtatccgacatattcgtaatctacatcccaataacgggccatcaaccgaaggaaatcatagccataaccgctgcggttcccctcttcatccatcatgtgataaccatccatggcaaagaaaccgactttgacagtttcatgctgcgaactgtcctcggctgcatatgcagtctggggagaaaatatcatacacacgcatacaaaaaccagtaacactgccacatatttctttgctctcgaaatcatattaaatctcctgtctgtcaaatatatttctctatacgtctccttgtcaacctcctgttttaataaattttcacctgtccctactgcttctcaattcttcgcatatagtctgcttgattgttttatcatctaatggctttgcaagatgtgcgttcattcctgcttccatacacctttcggcatcttccctgaatgcatttgcagtcatagcaatgatagggattgtttttgcatcttgccgttccaggtctcttattgttcttgcagcagtaagaccatccatcaccggcatcataacatccattaaaataacatcgtatgttcccggttcggaagcttcaaagtgctgaacagcttctaaaccatttttcactgtttctactttagccccattttccgtcagcataaattctgctatttccacattcagctcattatcttcaaccagcaatacccggatatctgatatatctgcatcaaaatcttctttttcttctggccgtacattcgtatcaattttaaatggaagtattacagtaaaacagcttccttcaccaagcttgctttcaactgttatggttccgcccatcttttctacaagttgtttcacaataggcattcccagacctgtcccattataatcagaacgtggggaattatctgcctgtacaaatggagtaaacaattcattttttataaattcttctgacattccaattccagtatcttttattttaaattcacatgtcatatgatcttctgatctttcaatcgttctcatactcatgtaaataaaaccattcaccttattgtacttcatactgtttgtaaacagattcatcaatatttttttcagatgaactgcattgctccaaacatatataccactgtaatcatcatgttctcctataacatgaagtcctttttcttctgcctgaaaagatagtgactccgtgatttcctgacatacctgatccagattgatggattcatcactaaaaaccacggtatcagattctaactttgccatatccaaaacatcatttaccaatgataatagcagtttcgaagactcatttattttattcaggcaatcttttgcccgctcaccatcatttccgcttttttcaagaattgtaagcatgcccataatgccattgatcggtgtcctgatgtcatgagacatgttatttaaaaaggaagtcttagccttattggcactctgcgcttctgcaagtgcactttgtaattcctgctgtttttcttcaagctcctgattcagcttcaatgcctgctcagcagacttcttggatttttcttccgcacgttttgattttttcaaagaatcaagaattatacacagaacaacgaaaaaagaaattccagcgataagtgaaactgtcagtaaattgtcctgaataaaatccttcgctgtaacttttcgtgaagaagcattatacgaaactactgcacctgaaaattgagctgtaggcatagatgtcagtgttttattcagaatggacaaaagaaccggttctccctgctgaacagcaaatgaaacatcagcttcttttgtcagaaaaacactatgaagcttattatttttcaaatagtctgaaacagtacctgaattgcttacaatacaatccgtctcccctttctgcattgcttttactgctgcatctgatgtctcatattccacaacctcccattgcggataattgtatgaaagatatgccttcaatgcaaaattatctttttcaacggcaactatattctctttattttcatcaaaagaatcctttgccgtaattgctgccatattgagagtcaatagcgtatccgacaaagcaaatccatttgtttctgcaaagtatggattctggtttgcatgaaaaatcaggtctatttttccatcctgcaatgcctgaagcagttcacttcttgtatcatatccatttaattcaaattccagagtctgaccttgcagacaattttctgcaagatccacataatctgtgataacacctgtcaatttacctgttaatggatctacactgctgatacctccatcctgattcagatacccaatcctgagtgcaccatgttgcccgatccactccctttcttcttttgaaagaaaggagctgctctgtgcagaaagataacgcctgtagagatcatctgtgtaaaatgggttgtcatccttgattctgcgcatagcactatccagtgcttctttgatatccggacgttctggatttataacgaaatagatttctgtctctccaatacttgtaatcggtgaaatatccgattcttcccaacgggattcttctaccgaaacaaagcagtcaatttcgtgtttcgacagtttgtccataacttctgcggtattagaaacattgatatgcttcgtatgcagaccatattttgattcccattcattaagcacatcctccactatattatctttagagacaccaatattttttccctcaaaagaatccaaatttcctgctgtaagatccatattggatgcatccgtatagatgtaatatttctcttcccccataggcatatcggaaaaaagcatattttcagcacgttcgtctgtataggaaatgccaccaagaatatcaatctctccatttttcaactgtgtaaagcagtttttccaatcacttgttatgtatttatatgtccatcctgcataacctgcaatatcttgaagatactcataaccatatcctcttctttcccccttttcattgacggtattataagtttcttcaaaagatcctacccggataacattgtcagagttttctttggcaaatgtaggaacggataaaacaataaaacatataattgtgcaaaatataatgtaacaaaatttgaaattcattatattctgtactaatttgcacttcttcatctttctcccctcctctaggctacagttgcttgcttccagattttaattttacattcattaattatcaataacctccccgctatttttcacaatatttttccaaacagcttctgtattacttattcaagtgctctaccagaacaaagcggacaagtccgcttcaaactccctcaatccctcaatccctcaatccctcaatctttgagggacttgttacgctttgcgtcccagactttcatctggtttgccgatttccatattatagctttaatacttatgcaaaaaaactggttttattatactatagcactctactgtacacaagaaaaaacattaccgttttaacgcctgaaaacaaaaaaagaacagccgatacatatactcgaactgttcttctacttccgaagtccacgcagcattgacattactgtttcctgcttcttaggttgacggctagatacgcattagagatgtctccattgtaatgctatttcttctaatggtaaccatactaactgttctccgtcatcagttttactcttacacaattttaaatcttcatccaaaattttcataatcttgttgcaccaaaatcatttcaatatcgtttttttattaaattaaaaagtctatctgcagtatccggtcctgttttgccagtttgctttgattgattgactcctacaaatgaattcttcgaaagccttgttgcaaacacgagataatccttaaacaactcgacagcttcattctgaataacatttgcagcgataataacgtcaatgcctggattatgattctttaactcatcaataatcctcattattgattttccagtattaatcacactatcaacaataactactctctctgtattaatcacaggagcatcatcttgcttcgggttcatcgaataaaaaatgccgcctgctcccatatatactccgtcaccaaaaaacctgccacctcgttccaaaactaagattgatgtatttttctctgggaatacggtagcaatgcgccttcctattttttctcctaaacgcacatgtgctgctgccagcctacttccacttattcctgaattcgatttgcagatagcaatatcagcttgtacttcttcgtcctcatcagccaatatcaccaaagaatgatcgtaaatcggcaccaagcctgataagctttcattcttcaatgatctgcttattcgcttaccaatatacagaaatcctttatcagcctcgcgtaacatatataaatcaatcttgctatctccataggcaaaaatagtgtatccatgttctcgcaattgctttacgacataatacttaacatctgcacttatgtatggactagcaaatatagttccaagattcttagcattagcaatatcgctccacaaatcttttattccagaagaaagcacaacataattattcgatgcaactatgtcatacacttcattattaattgttatctctgcaattttagatttgtcaatagacgcggtttgtaattccttttcaaaaagaaatgattgatagccagtataaaaatctccatcgaagatctttgtcttgccattacaacagaacctatatgaatcttgaataataatggttttatctccgtcaaccatatacaagatatcctgcttgttgaactgctccattatttgattacagatatctgtcgctaaatcataggagctgaaaccttctcgaagtaaagataagaaatcaaaaaacttattctgttcttcttcattatcacttacaacgtaaaagtccttatttcgcctatgacattcctctctaagattatttatttcaaactcctgccattgtcttaacgactcaatggactcgccagcaaacttagcatttttctctgacaaagcatatctttccttaagattttccggagaacaatacagataaataaagatgtcgtacaaatctccgtcagcctcagtaaatgcaacagtttccataaatgaatagtgtccatctgaaacaattacttcatcattcaaaccattaatatattctgtgtatttaattctaacttgatgtttctcttcttctgatagttccaaaaaggaaccaccgcaaatacgtctcaactcctggctgccattaataacctttgcatcagttattctatccatcaatgtacttttgcctgcacaaggcattccatataatgctattttcaaccagtaaacacctccttgaaacaacagtttctgtcaaagtcgataacgtcaaaactgacctcatttagaggtgtgtcgtaaggcattgaaaaaggtaaatcaatacaattaccacatatgaatatctttccatttgcgtaaaaaatattatccattcctgcaccacacataccaccatacatggtacagtcgtagccaccagttctaacattcaatcgttccatcgccttattcaagaacgcattaaaatcaggtagcgatatcccctgttttccaatcatcctagaaaacgtaatcctattaccaaattgttcaaagaactctatggtcgcttccggattatcaattatctcttttccaacagtacaattcatagaaggatacttcccattcacttctttatataaagctatattttccatcactcgctcatgagttccacatctatacttgtcgtgaatagcagagattccatctactgaaaagccaacatttacattgtattctttgaagaattctaacttctcacaatcaactaaaagaccgtttgtaatggtgtacgcagcaattcttccagatttcaaataatcgccaatatgagcgatatactgcttaagtttttcataatctaacattggttctccattacccacgaaccctaacttaaacaaatcaatatcgttgtcttcaatatgcgaagtaataatatcaagaatagtaattacatccatattgtcctcttgaatgtaattcttcttctcctgaaaatggcaataagtacaattgagattgcatcgattatttatcgatatacaagctcgtgttaccatcttctattcccccttttctgactattcttattgttacctctattaaacttctttcttgtaggaccagattcatgatactcactaacccaatcagcagcagttttaccatcaatgtcaacgatcttctgatcagctcctgcatcaatgagtatctttcgaatatcccaagtatgcttttccttattattttcaaagtgaccattcatgcaggccttcatgagcgcagtaaatccattagcgtcctgttggttaatactggttctttcatcctcacataaagcaattacaaaatccttctttccctcccaggcagcaatcattaatggcatattgccctcattcttctggcgtacttttccggcatcaaaaggatttctacttccaacattaggatttgccttacactctaaaagcaaaaacataaacatctcatactccttcatctgcactgcatgcgatagagcagggaaatatctacgactgcaatcacgcttattcacatctgcaccaagctgaatgagccatttgattttttcttttctttgctcaattgtggccctattatttcttacagcagaaataataagggtatttccatcctgaagatatgcattaacttcgtctgctgtcggttcttcgcattcctcatatgaatctgcgtaataagcgtcaattctagccaatttagtcatattgataagatcctgcttagtagccatatattctctaagatgtaatgctgaaacggattcatgccctttaagatatgctgaataatcggtgtcctctgttatgatatctactttgcagtgatatgtatcagaagcctcctgtgcaatatatattattttgcaatcttcgttatcttcatcagcatcgccattatattccataagaattgtacgagaaccatagctaataccacgaataacttcccaagcctttctcccaagagaacctgagttcttattctttatattatctaattcatcaacaactacctttggaataactaccttgctatattccttgttcagttcatcaattaactgtgaattcttaagtaacgctgaagtatctggaactgcaaccttctcccctcttaaaaattgttcggtctgtgattctgacatttcaaaaaccttacaatattttcttgccatttccaatagagttttttctgcagtttttccaccttcaacacgtgaaatagacgacttgttcataccagttcctggttccaagccctctaatacatcaatcttctttgccatgccatccatggtacagccattcttttcacgaagctccttcaatctcgaacaaaggaaagctatctgattatcatttgccataagtaacgcccctttcataggtatgtatgtaatttgattatttgctttatctcatactctcattatatacctcgttatatttttcacaacgaaaaggtgtgtttttgcaacaaatattcaaaaggcgcaacttatcacttcatttacttaatatatgcaactaaatgaagctacttgcagcaacacaaatagatcagttgcattaaccagctattcaaatttctaaatgcatcactacttcttataatatcgttgtctattctccgaattatccgctctgtcatttccatctgtgtcacacttcggtccaacttgagccgaagtcatatgatttgcttcattacctgccagcacttctgctccattatctgacagtgaatcatccgataaccgctttccctgatgtttcatggcatccagcttcatcttatacgcaaatgctttctcacttggcttcagattctctctatgcaggttagagtcaaccattgccacaactgactgagcatcatccaattctcttatcacaaccggaatcttcgtctctcctgcccatatagcagcttccattcgcctgtgaccggatattatctcatatccatccccataaggattcgtccttaccagaagtagcacaatcactccttctttctcaatactcttcatcagctcgcataattccgtatttacttccaccttaaatggatgattcttaaaatcatgcaactggtttatttccacattccgtatcgtctccataaaatcgcctttctcgaatacatcgaattcatctattctgaaatccatctgatacgatgactttcagatacaaagaaagaccgctcactttcaatttttcttgaaaatgaacggtctttcacgcttctgttatttagttgaatgataaatgtattactttctctttgatgtgtttctgaagccgcaatccaataccacagacacgtttactccatcagaaatagcctttttatacgtttttcggtcactctggtcaaacctgaaaaacctctcaaagtgcctaaaatcaaggattcttacaaatcggtccgatgtagtgcaactattgtctctatatgcgtctgcgtttctgcagatacttctgttacgattgtttcctgctctgttgctgctgtactttctgtctgtgccggtgacggtgactcagaaaaagtctggtctgctgcaggtgctccggagcatgctgccatagacattgccattacaacagcaagcatacccttcatcatactcttaattctcataatcgtttctcctctctgaaacatgttttgtttttcctctgcttcactatacaataccgttgtaaaaaccaatgtccaaagtaggaaaaatttgagtaaattccgacacttattttatgcagttctatctttatgagatttcatcaacatcataatacttaaaatcccggaagcaggcacttcctcctgtttcctctgccgcataacagaacagaccaaaccggcaaccagtaaaatgatccagtttgaagtacagcttatgcacggttccgatgggtagccagtctcccttatttacccggtaatagcagcgtgcttcatccttcatgttacagaaatctgcttcaagacgaaaatctatctggtgtgattcaacaacagttccttccgtcatatccaatataccatcttcttttttatccagcataaggacttcatattttccatgatgttttgtaatgccaactgcagcataacagctctgcaacgcacacaaacctgcgatatcgccctctttcaatgcagaagcatcaacagtaacctcagctgcgcaggacggataactcatcctttgcgtaagcgtatttactgcctgtgtaagctctgtacaaacttcccgtgttgtaattgtataggttccctgcaatgcatccagatgatagtaccgtggatctggatcatgattaaactgccagcgcggaagcaacccattacagaaatcatcacttcccactaatggctgataaatatatcctggtctggtactgtgaacctctatttcttccggcacatgtccgttctgtccaaaaaacggaaaatgatccttccaggtaaccggaagcagaataggaatccgtccaactgctccggaatcctgaaacagcattgcataccactttccatccggcgtatccactattcctccctgtgccacgccctgtccacaatatccacgatcatcacaaagtacatctccacccgtgaattctccttccagagaatcactgtaaaagcatgcttccgtccgcatccagcggtctctcagggaatgaaccagaaaaatataataatagccgtttattttttgaatatgagaaccctcatagcctagctccgggttcttatgatcactgactaaaagacgatgtaatccgtccttctttggtgcagtcaaatcttcattcaattctgtaatccagatttcatcatttccatatacaatatagtttctgccatcctcatcaaataataaagagccgtcatgataaaagccttctatcagctgctttttccatggaccatctattttttccgaagtatacaaataagtcttacgggtatcatttgccacaaagcagatataaaatcggccttcatgatagcgcagggaagctgcccacatgccctgtccgtaaatattctgaccgcttttcagttgctgcgcatccgtatgatccaacgtctcatagacataagtcacatgctcccagtgcaccagatcaaaagactgcagaatctcacagcccggcataaagtgcatggttgtggataccatataataggtgtcttctacgcggatcacgtccggatctggataatccaatcttgttataggatttacattcattgtttattcctttctgttttatctccatattctttgttctattctatttttactattttatctttgtttcttatccgtctgccttttcatctcttctctgccccatttcactattgctaatatcacaatctcacagtaaaatataatcctgtctttgacagttcaataggcaaaaaatcgctataggactttaaacttaaggcttgtagcgattttggttttcgttttacaatgtagtaatttatctccttttactaattttttgaatttctttcatctttcgtttggtaatgaattgataatccgtgttaaaaccacttatatcatgaagcgtatctgtaagttttgatcgtctgtaaaggggctggaactaccccaaccgactaacgtgagggcactgaaaaactgtttttacatacaatatatagtagtgtaaaacatataagtatgctttaccttgtaccgttttgtgtaaaataaggactttttcagtagcgtcgactcgtcggatggggttttctgctctataatagataaacgagagcagacagaatggcatttatatcgaatttgaaatcatatttatcccgaatcttacggcaggtcttgtctagctgcaagccatagtaaatgtattgtagaaagagataaccaccacaataaaatttttgctggttgaaatcaagtcttcggtcggcatgaaatgttatctgcacagatttctcagcctgttcctttttatatttttccgtttcgagtcgggcttcttcacgtgcccaagccataacatcatcgcgtgttggcccatgttcttttaataattcattaaacacgcctaattttctgacagtggcagaagtgctttttcctttgctgtttttaaaacttttggtgatataaaaggattctgaatttttctatttgttcgttgtaactctcataatttctccatcttttttagtatagcatactattaagagaattaccactaattactactaaataaaacagaaaatttgacataaaaaatgcaggtagatcaatacctgcgaccactttttctaatattcaactgtcaaactcccaaatacgaagcatccgtaaacccgaatgtttcagctattaccattcatcccgatttgttttctcggctgggcatcttgaaaaatgccatatagtgcttgcatatttcacttgtatagatagcaattggggtatgtgtttgcggacacatacttggaggagtctgtaaattttttatcattcatgccttctaatttttctaatacctgcccggcaatatcttccatatcgctgtcctttatgtacggcattatccgtctgatttcttccatcatcttcattctgttctgtgtctcaaaaacacacatgaaattgatttcttctactgtgaatttattcatcatcctatatccccctatatgaattttttggtttttccagttccttcgtatccttattgtttccctgtgttgcttccttctgcttggctgccagtcgctcctttaaagaagaacgtgcttctgacttttcctgctgttctttcttttcttcctcacgattgaattttcccacgccattgttgagcctctcatcaatcatgttataattctgctcctccagttcctcaatcttagcaagcgacttgtattctgccaatttcacaagcagttcctttgcctgtctctcactgtcctcgtctattccttcgtcaatagataattttaatgtcactgccacacaggacagctttctgtcagtagtattaaaatatcgctgccagattttgtttacaaccagaagcaaactggatgaatactgtactctgccattaaaagaaatagaggatatgaacgctctcttccagctgacatcagtattttattcagaggcagacacgtaccggccaacagttgaaaagatcatcgaaactgttcactctcatacttttgccgtggaactggcagcaaaacttctggaaaatggaatctcaactccagaccagttattaacaagacttcaggtggaaaaagcatctttccataacgaagataaaattaaaataatcaaagatggacaaagcagcaaagccacctattacagtcatatccatacgctgttttcgttatacactttatctcttaaacagcaggatatcatgtgtaatatgtgctttcttccttccaccggtatttctgcccgtatatttgccaaatggctggaactgcccacactaaatgagatcaacgatttaattgagactggttttgtccagacaacaaaacgtcgcactatctctctgcatccgatgattcaggaaatcaccctttcagagacaaaaccatctgtaactcgctgccacatattactggattctttacagaaaatatgtttaatgcatgggattgaagttgattattacaagaagctgttttagacagcaggaaacatcatagaattgattgaaaaagatgatataccaaaatatctactttttctggaaaatgtttttccatatatggataattataattaccagaaaggtatgaaagcaatcattcaggaattgaaaaattttttgaagcgtaaagacattggcaccgattctgaccgggcattgttactggattttcaggctactcttgaaatcaagccagaaaaagcaataaaactggaaaaggatgcacttgcccagatagaaactatcactgctgacaatgctcgccttgtttccaaccttcatgccaatctcggtggactttaccgcatgaacggtcatcccgatcttgcaagagaacacatggaaaaaagtatctcactacttgaccaatttaacctgcttcatataaatgacagcatacctcagattgccaattatgcaatgttcctagcagaacagcaggaacctgaaagaggaatctccaaattacaaagattatccggcatcatcaaagaatatcattccgatgactgtctggattatgccaaagtacaggaaacccttggaaccatttatctgatgactgccaatcttccgcaggccaaaacacattttaaaagagctttcaaaatatataaaaagatctgagctgatgaaccagaaatgattaaagcaaaatattaggagattcaggagttatatccacagattggattttccattggaaaaactctatctggtcttttaacataatacgtgcaatttaaggcgggcaacttgcccgccttaaatctttaaattatgcttgatttttccagaaaatattttacttactttgtttttcatgagtatgaatacaatttttacttatttccgtatctgcgaaaactcttataaataaaaggcagtaaggctattgccatcacggtatacattaccattacaagcggaatttgtcgaaatacacaattcccaatctgataaataagtgggacttttacacttgcctgtacatttgtcaaaattgttggtatcaaattgaaaagcgttgtatacccagaaagtgcccgtcctataaatggcaataagcaatataaaaagaacggaatgcaaacagcgacactaattgtatgcattttagccgctactaacatagacactacagccgccagcatactggctataaatccacatacaactgtcaacaaatagtattgtccatatgacataatgtaaatactatacgcctgatacatttgataaggtgtattcataccactggttcccataattccaaaacaaatcacactaagtaatataattcccatacaataaatcataactgtcgtagctattcctgccagtatttttattttaacagcttttgtacgtccatactttgtagagaaaaatactgcatctgcttttgtctgaaaatcatctgcaaatattccagcacaaataaaaccaactatgattgacagaataatagaatacgtttctacatacataatcatagtatcccacgaactataagattcgtattctactggtaattttatttcattatatttcttttccaagtattttttctgaacagaagtctttccatattcttctgccatcttttccatatttttatgataagtgtcatagaactcttgtatattttcttctgtaatttgattcagaacactttcatcatattctgcatccggtgttgataccgatattataaaactcctaatatcatctatcggttgtaatgtcgttccataaatcgcattttcttctgaggattgtgtcatcgcatttttattttgttctataacttttccaagttcatcttctgtcaatgtacctttccatgctcgtctgttatctgtaagttttcttgttgccataattccagtactagcatttccattctcatccacatagcgattacttgtaactgcaaatccgctaaaaatgacagcaagtatcaatgccaatccgattgcaaatacattaattttctttgaaaaaactcgttttaattctaatttaagcatcttgtttttcctccgatttttctccaaaataaaatagaaatgcatcttccagatttttttctacagccacagcatcttctgttggcttttctattgaaataattctaatctctgctccggtttttgttgtttttatatttccaaccaaatattcattcatatatttgtctatcatacttctcgaaacattacattgccataccttttctttcatagaagatactaaatcttccgcagtacctgcataaaaaagttctccatctttcattaacataatgttattcgcaatgtactcaatatccgatacaatatgtgtagacaagagcaccaaacgttcttccgacaattcactaattaaattacgaaaacgtattctttcattcgggtctaatccagcggtaggttcgtccaggacaagaatttgcggatcgtttaacatcgcctgtgctattcctacacgtctaaccattcctccagacaaattcttcatttttcttttactgaatttttccattcctacttgatttaataattgcttcactttttttctggcaaacggtatttttaacccttttatagaagaaatgtacatcatgtaatcatatacggtcaaatctgggtaatatccaaaatcctgtggtaaatatcccagaacttctcggtattcacctcctagtttccatatatctttaccattccataatatttgtccttctgatggttgaacaatcgtacaaagcatacgcattaatgtggtctttcctgctccatttactccaagcagtccataaattcctttttccataacacaattcactttattaacagcatttacttctccgtattgttttgttacatttttaaattctaatttcatacgtgtaatcctccaaaattttttcatcaaatagcaatgacttctgaacaaaaaaaataaaatatacaaaagtcaatatcagcatagccacccataccggagttacaattttctgataaataacatcatttgcaacaatcatcatccataaaccaacccataccagacaggaaagcactgctatatattctgatttttcccatctgctgtacaatacacgaaaacatatacaacatgaaacatttactggaagcaaaaaattaaccaccaaatcacttaacgagagtattgttgtttgatatgtaattgccaaaaacaccataacgatcaccagatccactactccaaacattaacattcttgctgtacaaatctgacgcagtgtgtaataagacgcctgctcaatttcaatcgcaccatttcttctgtttttccaaatttccgggacaatcagaaccacaaatattgtggcagatattcccataatcctcatcatatcttttatgtctgacgtataactactcaaccatatccatagacacataagaatacaaccttgtaaaatccaccatcttttttttatgaattttgtctgctcatacaaaaattcaaaataagatgttctatgcaattgtttcgataaaaccgactctgacaaaatattctgacatgcttttactgttttgttctctgcttcagtccttacatacttttcttcaatctcctctttatattcctttatttgttgcttataattcttcatcttttttcacctccaactctttcattaaaagttcttttgcttttccgattcgatattttacaagagaaagtttgatatgaagtaattctgcaatttctctttgcttcaattcctgaaaaaaatataaaactgccgtttctctaatttcttccggtaactttctcactgcctgttcaatcgttaatcggactcctagctcttctacatgatttttactacagtcctctgattttagcagttcctctgatggaatatcttttttctttttgtaataatttttaacggtatttccggcaattgtataaagataattcttaacttttccatattctttatatctatataaattggaaaagaaacgtgtaaacacttcttgtgtcaaatcctctgcctcatagggatcattgatatgtagcaaacaatattgatatatgcttgagtaatattttttgaccagtttttcacacgcatcttcatctcctgctcttgctagatgtactaacaaagaatcagttttgtattccattcgcaaatttgcctccctctgttttctaaataatataacaatcctactataaaaaaagttagaattttcttttgtttttatttatatttttctaaatattcttccaaacataaattttcttctttcattattttagcgacagtcgttccaacataacggtaatgccatggttcattactaattcctgttatatccgttttatcttccgggtaacgttttacaaacccatatttatatgcattttcgtctaaccattgatatgctttttcagaagaacatttgtcggtatccgcattaatatcaacactcagtcctaattggtgttcgcttgtatcgggaattgcaacatatttctcggctcttttttttgcttctttcgcagaatatccttgtttttcatattcattgattttctcgtccataattttttgttgttctcctgttgttcgatatccttctctaacaaacagtgctagcccctcagctcttgcatcattaaacatttgttgtaactctggataaatccgtgaatctacttttttaccattcgacaattctgtcaattctacttgataattatttggaatataatgatttcgatcgaccaaaataagattccattcacccgaagtgtctgcaaaggacttttctgactgcaaaattttcggtaatgttaattctccaacctgcacatcgatttttattgttctccacattacaacggttattatgatagtcattaaaagaatgaatacacgtaaaatattctttcttctgcgattgctgtatcttcttttgttcattttctctcccacattttcattatcaaaatatttctacttttaatataattaacaaccaaaacaacaaaagagttagtatctaaacttatttatcaataaaaagtttattttttctcaattccagctcaatttcccctcaatgcctttttcctccgattttcgtatgcttatcccacagcagagcagtaccacaccggtacgacctgctgaatcaatcaatacgaaaaaaggaggggataaaccatgcagaacaatatccgcaacacaaacctgcgctttaattatgatgtttccccgttttcttctggacatggaaataaacgaaactgccaaaatgctttatattatcctgctcgaccgggcaaggctttcctagaaaaatgagggctggtcagatatcgatggtcatgtgttcatttactttacaattgaagcactggcagaagttctccacaaaagccagatgacgattaaaactgctctggcagtgctggaaaaacaggagcttatcttccgaaaacggcagggacccggacagcccaaccggatttatgtaaaactcccaaaagaaaccatccactatacagacagatttctttccctaagacagacagaaaactgtcctattgacagacaggattctttccctgatacagacagaaaactgtctggtaataaaaaagagataaaaaagaacaatttagaaaaaagagggagtaaggagccactctcaccctatggaaaatttcaaaatgtttttctgtcagaaaaagagcttgaagatatccggcagacaatccctgactggaaggattatattgaacgcttatccggttatatggcttctaccggaaagcaatatcagaaccatgcagctaccatcatcaactgggcaagacaggatcatcctgcttcccggcgaagaaattacgaaagtgaggaatacgaaacactatgacaagatttatagaaaaaccaaccgctataacaccaaacagagagcttcagcctgatgaatattttaacaaaacagaccacctgatctactgttccaaatgcaatacgccaagacaatgccggcatgaattacagggaaaggttcttattccttccatccgctgtaaatgccagcaggaaatctttgagcaggaagaagtccagagaaaacttcatgaaaaacaaatggaaatagagcatcttaaaaccagcagcttacaggacaaagtcctctatgactacacttttgccagagataacggcatcaatccggaaataaaactggcacacaattatgtaagcaactgggaagagatgaaagcaaacgcttccggacttctcatctggggtgatgtcggtactggaaaatctttttttgcaggctgcattgccaatgcccttctggaaaaaggcgttcctgtactgatgaccaacttttcccggattctgaatacccttaccggaatgcattttgaagacagaaaccagttcatcaactgtttaaaccgctacagtcttcggattattgatgatctcggaattgagcggaactctgactttgcactggaacaggtattcaatgtgatcgacagtcgttaccgcagtaaaaagcccctgatcataacgaccaatctcactttatcagaactgaataacgccgctgatatcgcacacaaacgaatttatgaccgtattctggagagatgtcagaatccagatacgtcctgattttcgggataagctgattgaacagctcaagggactttcggtaaatattatgactatcaccgtcgtgatattgcagccaatgaggtggattatctcaatgtggaggatcctgatgttttctcccatcgtgcatgggatcttgaatatcagaggaaacaggagatgcgacgaaatcagcctgttcgagctaagaaaaggtcacatgatatggaattataatttcctttaaaaagaggcgcatggatccatcaaatccatacgcctaatttgcacattgttattattctttccgaatcctttcaacaatgctttcccgactcatcttttcgaactgatactttggtaccacatacgcaatcccaaccaaaatcggaatcataaacacacatggcactatcgtaagatgcaaccggaagaaaaatgccgtaccgagtgtatttgctaaaatcttctctgccccaaacacaactaataatactgcaatcacaaatgcgcctcccaaatataggaatccctcagccactagcattttcgatatctgttttttcgtcattccaacaacttccaaaagtgccagttctttttttctgctaattacagaagttgctgttgtattaaagaaattcataataccaataaaggctaaaataacgacaagaaaactaccgatcatataatatttactgacataccgctgaaagctctctttcatgtccaatacagaaaaaacattcatcatatcattttctttcaaaatattttcatcaatgtattcttttatctgcttgtccttgcccttctttgcatcgatggcagcatacatggctgattcatttcctgtctgggtaatatactcatcttctggaactaataccgtaatatagataaggtctgcatacggataatccaatgcatatggcatcagtgcttctccaatgacttcgtaatctttttggtttccatttttgtactccatttgaaaaacatccccagtctgataataagaaaccggatgctctgcatatttatcaccataatctacaagcacataatttccgcttttaaatgtatcccaagagcatttttcccctctccattctaatttgtcaaacaccgactcgctgattccgagaaaatgaacacttactgtattggaagcctttgcatcttcccaaacctgttcttcataatcggtccagtttttttcatatttatctgcgaatgcttcccatgttttcagaagttccggctccatcttgtgggtttcttcagaataatacacatatcctgtcttagcactatcaggacattcgtccaaaatctctttgatttcaggtgtaataccgttgaaattcgtatttgacaaacttcccgtcatctgatccagttgaaaatcggaagctaaaaacacttttcggtaagaatcaaaatcatatccctgcaccaacatcacgatacagttgacaaccaccatagaaagagcgatagaaagcataacaatcaatccctttttccaatttcgtaacacattttgaactgccatcccccaccaggttacagaagtattcttttttattttcctatgtgactgctctccttctgccaaacgcagagcttccacaggcgaaactctttccaccattctacaagcctgcagactggagagatacaccgttaaaagcgttaaaagtatcgctgcaaggaaaatcaaaggattcgctgatactactgtctgagccgtttttcctgcctgtgcactaatttcaacatctgcagtcaaggacggagccatacaaagacctgcaagataaccacaaaacaatccgattggaatgccaatagctgataatctccacgcctgcatacgtacaattttcttcaactgctttcccgttgtccccacattcttcaacaatccgtaagcccggatatccgttttcacagaaatgttaaaaatattataaataatcaggtatccagctaatatgacaaatagaatcattataattaaagaagaaaatgaaaatgaatcctcttcaaagagattatatgccggattgacttccattcctgtcccagctctcgtaaatcccgctgctttggatatcttttccgttttcttttccagattccaaaggttcttgtaccagacagaatactctttccctccattgtagatgccattttctaattcttcctgcgtaacgggataacaattctcctttgcataggcttcggatacccagaccatctgacctaaaacagctttatccccctgccagaatccacatatctgaaacgtatctgtcttatattgtttcagcatgggatttacttcccaggtcagcgttacttcttcaccaatctttggtgtaacacccagagattccaatatcgtgctgctaagtgctacttcattttctttctccggcagtcttcctgtagttggcagacaattaaaactttctgccatattttcatctgcatatcggacctctacggaaaatccaaaccgttcgtccattccagctcccagaaaaataccggaaccatatcgttccacctcatcactttgttctattgttttttgcaatctctccgcatcttcttctgacaaattctgcgcaatagcatgggatgaatccataaattgcttaatttccgttgctcttttggaaagtatcatggatacgctccccacaaagaggcttgtaaataacagtgatgtcaacatgattgcaataacagcaataatatttcttgctcggttcattttcataaaacgtttcgtcaataatcgtaacgtttctttattctctacttttaccatataatcgccctcactataccaaaccactgtctgaaacaatttttccgtcttcaatctgtaaaatcctgtcagccatctgggcaatctcctcattgtgagtaatcattacaatcgtttgatgaaaacgcttactggtgacttttaaaagtcccaatacatcctgactcgttttggagtccagattgcctgtcggttcatctgccagcaaaatagcaggttttgccgctaatgctcttgcgattgccaccctttgctgctgaccccctgacagtgcacttggaagattttccagttttgtccgaatacccagtgtatctatgatttcatttacataacctttttcaatcttttttccatccagttttacaggaagaacaatattttcccatacattcagcatcggaaccagattatactgttgaaatacaaatccaatatttctacgcctaaaaatagtaagctcttcatctgacatatggcttaaattctgtccgtcaacaatgacctgaccagatgttggattatccaaaccaccaatgatatgaagcaatgtagactttccacttccagaggttccaacaatcgctacaaactcccctttttctacttccaggtttataccctcaagagccctgacttctgtttctccctgcccatatatttttcgtaaatttactgcttttaatatattcatgccatcctcccatcaaaaaagcctgtattgatctttacaatacagactttatcataacaatgtctccatctggtttctgaaatgtcacagttttaatactattccttctttgctatcggaagaaacacagaaaatgtagaaccctttcctctctttgatgtcacttttatataccccttttgtgcctgaatgatctctcttgcaaggaataagccaattcctactcctggctggtctgccactgacagactccgataaaaccttccaaatatctttggtatttcttctttttctattccaatgccatcatcaatgatatcgatctttacaaagaaagaatactgctcggcttttatctgaacatttcccccacatgctgtgtatttaatcgcattgtctacaatatttccgagtgcctccacggtccattttgaatcacatcgaacatgcaaatccgtgtcacataggctcagagtaatattcttctcccttacttttacgttaaactgctgctgtatagattcaagcatctgcttaatagtagtatcctccgaatgtactgcgataattccactctccatccgtgataatttgaccagtgattgtatcagaaaatccaatttctccgtctgctccaaaatggtagctatctcctcttgattttcattactcacttcagagagtatttctccatagactttcagatttgaaatgggagtcagtgtctgatgcgcaatatctgaaataagtttttgtatcacttctttctgttcctgttgatttttttttgccagaaagctactgtctatatattgtttcatgctgttttcaagagcagaatacttttcctctgatatttctgtccgttccagttctccatctattgcacaatccagcatttgctgcaaccggttcaaaagctttttttctttctgataaaaaaagctgtaccaaaaaactccgctcaggacaaatataactacaatcaacataattgtttctatcatccattcaccgcccaggtataaccaattccataaaccgtcttgatatattcaggcttctgcgtatcatcttctaatttgtctctgaggcgtttgattgcaacagtcaaggcatgggcatccacaaactctgtatctccctgccatacctcgtcaatcagatattcccgtttcaatacttttcctctgttttcacacagcactctaagaagcttttgttctgtcttactaagttcaataggttctccatctttgaaaaattccattttatcgaaatagaactcaaatccatcaagctccatagaatttttagctgctgcctctttatttctaagctgcacagacactcttgcacgcaaaaccatcaagctaaacggtttcgtaatataatcatttgccccagcttccaatcctgttacaatatctacttccatgttatttactgtaagcaggataattggcacctgactgtttttccttatttctcttacaaaatcaatcccattcccatccggcaagttcacatctaataaaaccaatgtgatatcttcctttttcaagacttctctagcctcctgcaaagtctggcactgataaaagaaataggaatcatccttcaatgcgagacgtattccatcatttaattttttgtcatcttcaacaatcagtaacttttcactcatattttctctgctttctttcaaattacgctaattgtatcattgccagttttataaatcaaatcattaaatcaaaatctccagcagaaattatcttataaacagcaaaaagctcccgaaggagctttccacactttaaatatcgaccaattcttttaacacaatctcttctgctacattttggatattacttactgcactgacaagatttggatagtaaattccatctgctcccagtgtgtaggttccacccatcttttcaaatgtgcttttcatgtgttatttctccttgaaatcagcgatgtccttagatcatcgcaaaatatttcagggcagccttgatagcatcttctttctctttcggacactgtggcatttttggattttctgtctttggcagattatagttctctcctacttcgattccacatttccttttgatttgagaaatatataaatttgaaaccttcaagccaaattccttcagcacataatctttgatttcctgataggtcgctttctttgcagacaaactatttttagttttgcagcaaatcaaaatcctcgtctgtacactttcggatgattcgttttgtcttttcgacaggtagcggaacattctcttcatcgaaatattcgatgttcactacctctacaactgcctcatggttatccttgcctgcgggtacaagcacgaaatcaccgatttcaatgctgtcatcttcggtcagataataataactcttatatccttcgtcaaagataacactgcaaaagatgtattccgacttgcggcgttttgctttgccgtagaccgatgggtcaaggatttctcccaaaccgtagaaacgaatgaagtcaaatactgtttctgcaaaatctacgaaatcctctggcaacccatttttatcgtagcttcctgtaatggttcgtctcggatttttcttatactcaattgttatggtgtaatcctttgtttcgtttggtgtgtctatcacatcatcgggatttccttcaatgtgggcaaacaagtcctccgcatcgaaattttcaagcaagctctcaattccgcctttgatttcatacttacgagaaaccttacatccagtgccaatattctgaatatgctccaatgtttccgtggctctatcgatagtcagctgctcggtataatcccaggttacaaattcccagtctgcgttttctggtttctgaccaggttttatttttgtgaccctgtggtaatccagagtgattttatttatcacgtccggtttgcagtttccatcaaaaacatacaaatcatcaataccaaccgtatcacggacaaggtctgataaatctgtaccttcataatcgaagtcagcacacaaagagcccctgaatttatatgtgacgccttcggtattggtcaattccataatccaatcaccaatatccgtagcaaaaatttctgtatactcattaccgaagtaaactgcgattgcactaaacaacttgtctgccgctgacttatcaattttgaagttcttacttctggctttctcgtatcgttctccgcaacgaccaaagttgtatccggaaaaccaaacacgcccttcattattgatggttagatgctgttctacctcttcatcggattccggcataggtccatagcaaatattatttgatacgatacgtatcttctttagtgtgccttggaatataaaaggattctccccggacagcaatgccagtctgcttaatgccagaataaaccacgcacgatttttcggctccaagatttctgcacctgtatatgcccaatgattgaaatagcgccattgggaatagattgcagaaccaagcaagggaatatcggtcacatcagcgataatcctatccaaagcctcatggttgtttgctacattgccgtatttctctgaaaaggcatgaccaaagtccatcttgaaaccaagagtatcacaatcgtcagccatataatggtcaacgagttctatgtagttgatgttctggtctctgaacttatcgcaccatttcacagcgaaatcgtgtatctgtttcatatcagccactgtggtatacctcccattctttatttttgtggtatcgtatttacttatgtgttttagtcaacagaaccacgcactccacatgcggtgaaagttacttcttatactaaatagcgaaaccatcaccttttgcgaaaaggtttataccccacttagggggatagcgtttaccccacattccctattcttcaaacagcatatctttcattttttcatttgcttcctgatacaatgattccataaaagatgtcattttagtctctgaatatttttgtcttaaataattactgaatggttttaatttttcattttcataatactctttcaacaaaccaaaaatatcttgttgctgctcgactaaatacattaacatttcatattcttcaatattaaaattgaagtagtatttagttttttcacatttcttctctgcttctacatttttatgtatttcattataataatcgggaaccgcattaatattatccattgttacagaaattatatatgcatcttctactcctgtaaactctggcttaacttcaataacagtagccaaacaggtatctgcctgaataataggatttgcgaacattctattattatttttttcaacactttcatttttggtcatacaatctaataaaacagaaaatcctttcgcctctattactaataaattattatctttccgtatataggcatctgaagattttttattatttttttcataagcaaattcctctatatagaaataacttccttttgtagcctcttgcgttaaattttgaatgtacttttcaaaaagtctcccaaaaaatgccattgctctactatcatttttcggataacaatctctaatcatccagaaaatcttttcaaaaagtgcatttctcaatgtgatgtcacataccgatatatagtttcctttgccatctttgataaaaggaaattcgaagaacttactaaaatcccattcctgattctcactttccgatgcccatgttgcatagtcttttacctgttgtgataatactccaataactttgttgatcagttctttttctttcatttttccataaactttctcgacatttcgccacattgtatcatatatcaaaccatttacatcactataataaatgctcaattcccaaaaaagcaaaaaactatattgtgtaggtgtaaattgatacttttccgtaaaagctgaataataatccctatactctttctgaacatctacatcaaaattgtttatgtccctactaattttttccatcatataatacattcttagaaattcatgtgcaacatttctctgatagttcagatgatacgttgaataaagaaaatggcttttatcaaattcttctgaatgcttctgattaagttgttctgccactactaattgcaattgaataatctttttataatcttcttgtactatttcatattgtgtatcacatatagtttcataatttccaaattgaacaaattttttgagtaatataagcaacatttgaaccgaaataatatgtacatttctttttaataatggatttgcaaataattcttctggagatttcagaacaataccgcacatctctttctttaatacagtttcaaatggaattctaaactctccccaaaaaattcgtaccggatcaagcattgcatctcttactctaattaattcacaaataatagaaatcgccttatgcatattcatgttattgatttcttcttgcaaattcggcatttcatcagaaaaaacgtctgtatatcctaataacaactgtgcatcctctgcatcaactgaatacattttattatcctccttcaaccccaatttatagtatttttaatcattctgctctcgatatgttctgttttgttatcctcgctcgaaatctattttatcattgatgctattgtaccacagacatctcatttttactatttgaaaaagagcaagaaaaaagccgatcaggaatcgcaactcccaatcggcatcttttcttactcctcttcatttttacattcaatctccgttccatccaggaacactaccaacaatgttccgtcctcaaagaccttgatgtggtccagcgttttcagcatgaagtccgtgtccatctccgtcaaaggctctgccccatcggtgtattctatgaacttctctgcccgataaccttccaagaggttctcgctctgcagctgttccgtccactgctccatgaaatcctctcgattctccaccaacgcattccaagccatcagatatgcctttatcagcgtttcttcctccatgtgacggttggcacatcccatgactcctttgaccttgtagcgttcactgcactgccataccttacggtcaacacccatgctgctccgccagccttttcgtgcaaataccttattgcagtctccgcaaataatcttggatgcaaatggattgctttccggccggtggaaataggagtttgtcccatgctcctccaggtactttttcctgcgtttgatttcaagctgtacacattcccaaatccgctttgatatgatggcatcatggccatcctccacataaaacatctggatttcccctttgttctgcgtccgcttcttggtaaggaagtccaccgtatagcttttctgcaacaatgcatcacctttgtatttttcattctccaacatactcattaaggttgtagcctgccacttcgtaccgccatcccaattccgaactccctctttttcaaaaattctcttgatgtaatccgttgtttttccatccaaaaattcctgatacaatcgcactacaatcggttcctgcattctgttgattaccagcttgccattctcgtccgtgtcataaccaagaaaacgctttgtactcattttgtgttttcctgtttcaaaccttctgcggattccccatgtgcaattctctgaaatggaccggctctcatcctgcgccagtgaggaaagaatggtaagcagcacttcgccctttgcatcgagggtattgatattttccttttcaaaaataatccctatccccaagtccttcaactctcgcacataattcaagcagtccagcgtatttcttgcgaatcgggaaatggacttggtaatgatcatgtcaatttttcctgccctgcaatcggcaatcatacgattgaattcatctctctttttggtgttggttcctgaaataccttcatccgcataagttcctgcatattcatagagaggattttcgctgatataatttgtgtaataattgacctgattctcataacttaataactgttcttcttggtcggttgatactctgcagtacgctgccatcctcaacttctgcactgcctgtgctgttcctgattccgcagtcgaaatctactttgctggtataactgtaatacttcttgccatttcgagtcacctcctcaactactttctgttccgcaatatttaatccctgcagttctgcatcatcaattcgtatccctttacacgccttgactcccttttcaatgtaggtgctgcagagccattggattttcttcttgtaaacctgtctacgccggagcgtttttccgcagtaagggcaaatcagcattccgcttaagggatagcggttctggaacttcattgtgctgtcctgtccgatattcctgtcacgctttctctgttccctgacttcctgcaccttttcccatacctcaggcgttacgattggctcgtggttctccgaaatgtaataactctgcacttccccgttgtttttccttgtatggtttcttttgttttcaggggtgtaatacttctgcagatgaaaatcccctttgtacttttcattgcaaagcatcccattgatggtcccgctctcccatgttgttcccgtcaccgttttcacgcccaagtaatcaagcagctccccaatccttgacgagccgacattcattagataaaggtcaaaagtcagactgacaatttccgcttcctttcggttcacaatcaaatctccatattcgtttttgtcataaccgaggaaacgagaggtggtaatcatcacttcccctctctcaaacttctggtagtgtcaaatttactacctattttttctttaaaaacctttattttcgggagtttcaaataaaaagagcattgacctcccttttttggtataatgtcctcgaccaaaatttcactaaccaaaggagacaatgctcactagaaccggaagcacctgcccctcggcaaatctccgttcaaaagaaccattggaaaaatgatcctctctcagcagcattgtcaataatgctgtgcaaagttcataatctgccctcggaatacgttccaatttttcatcacagtcaatcggctccgtaatcatataatccccataattatttttcagatcccccattgtctttaacagatctgcatacagattctcttgcggattctttaattccaatatttcctgaatttttcgtattttctctgcctttgtcaatgctatacaccaccttaaaccttcgtagtttctcgaatatatgttctatattatcacatcgacgcagattattccatccttcagtctatatattcagcaaaatttttctctgcataactcacggcattttttatagcggcttcctttttcagagtttccctatacttttgcatctgttccgcataatcgtcagtttgtgacacgataatgttattaacagcagaaagaaccattccaaatttctttttatcgccatttgcaaattctatctctatggaacttccatgattatccgtaattgttcccagaccatatttcttatgctgaatacctgcgccaattttaaaaaccatattcagatattctaatgcttcctgcaatttcttcaattcgtcttgcgctgctttcagttcttctgcaaagcgaactgctttctctttcttttcctgtatcagctgtttttcttttgtctttggacgtttaaaagttataccggaaaaaaatccgtatgtagagcagcaataaattaaatcaaaagccagtatatgtttttctttatcctgcgcaaaagtctgaggatcaataccccatccattttcaaaccggctggtatccgtcttcatcatctcaggactatttttaattgcagatactatctgatcacacatgcggtaatagacatctaattttacagaatctccagatccccaatcgtcataaaactcaatacagtcagcaaatataagtgcatgactcgatttaaaaatatagttatgatctgaatcatacagaaacagatacgttgttactgaatgcatatcatccttatacagataacttcccggaaaatatttatcccgaagctcatggcttttcttcaaaaatgccgcaaccgcattctgccttttttccatagtcccatcagaattttcaaacagacttttaaacatatttctcactgtttccggctcatgctctgaaaaacgtatcaatccctgaaacggctgagtataactatccacaagattgcttgtaagtttcttgactttaagcaagtttgctgcaaattctgaattttcacttttcaacgcatcatccattaaaggtcgaaatctcttaacgatctgccatttataatattccatatgctcaggattattcagtttttcaaaatcatctatataatgcttaaaaatttgctccatatgaagctcattcatagtgttctcctccccatcttctaaatatcaccagttgttcagtaatagaatttgtgatgattcacttttttatcttttataaataactatatcataaaccacacaccttggaaatacagacaaaaaacaggcttcacaccacgaaccaactcgcaatgcaactcctcatcactcactattatattcttgtcacaaaatccagcgagatccacccattccgctctttctcatatgctttcagcagccccccactttgatgctccaacaccatcagcctcagcaacaatagtaaaacagccagcacccgtatattttccggtcttcctctgatccgttcccggcttcttccggatattcaaattcgaaatctccacacgaaccagatacggacgaaacacctcttccggcttcttatccacggaactgtacactgcctttccattctcatcaaacaccgaaaatcccagatgctcgtctgcacatttctttgcgttatccaacaccttaaatgcccccacctgactctccgcatcctgccagcttttccgcacatggtaccagacctctttttcagtcttcacacagtcaaatcttgtcagaccatacttctcaataataacgcagatcttctgcacatataaactgtccgttgcataaccgccgttcttaataatctgaacatccttccgataatctctttctccaaccagcccctcatatctctttttcttcctgttcattgcgcccaggagataagcagaatgatccgcaatcggctactccacacaggcatacttccgaaaatccgcagttaccgtataaagctttccagtcccatcatcctcctgtgtcttcttccgatacttacgggttccatcctaggcacttccgccccagctattcccagacagcacacacttcattccaaagcagttgtttgccttctgcgccagttccgtcctgccataacccgattccagaataaactgcgctgcagacacagatgccagaatcccgctggtcttcatatcctctgcacacagcactccaatccgctccgctgacttcccatcggaaagccctggaaacacagaagcctgcgtcccttcagctttcccagacatggcagccttcaccgctttccggaatccatccatcgtataagccagtcccagacctttccacagatgctctggatccccatggttcgtagtaatcccccttgcaggtccctctctatgtgaaattactacaccatccgccagaggatccagaccaaacttcttacacagcatggcaaacagctccaccgctgcttcataagtccgtactgcagatgcccttgccgtcaccagatccactggtgtaccgaatgcaggcaggctcacacatctccacaccaatatgcgtattatttccgcatcccttacttccggatccacagtgccatcccctgtgatcccagggaagtgtctaatacacagttccgtcatttccatcaataaatccatccacacaggcacttccaaaagaagccctgttccatgaatcaagaaatacctgcgcattcggctgggaatacccaaccgaatgaagcatcagtccttttaccgcaatctttctccctattatccgaatgaatgtgttgcatattcttttttctttgatccggtgtcaaattatccatatcaattaccccaaaaagactacatcattgtgatattcaagaaatgatttaccgggcaaaaatttatctggaagattgatttgtttaccttcatacccatagaaccaatctcttgtttgctgatccatttcagcatttttcatttctttagaaactatcagccttaatttactgtctaacgttattaaacctctatcaaaggccttatcatgtaatgaatttaaacacaatccattacatggatttgttctttcagttttttcatcacaaacattccaaggtttaatatgactcgcaattaacaaagatgattttgacattcctgttatacagcatttatttccgtatgagcttaaaacagccattctgaaaaaatactgtccaacacgatttttcattactcgctctttatattctcccggtggaatatcatcaatatctcccacatcaataatttccctaacttctacattttgcattcttgctcgaatttcctgagcctgatatgatagttctgtccaatcattgcaaaattcgctaaatatttctccatccagtttactgccatgtgccattgctgtaacatttcttttttttaattccggatcataatgcgctaaattatgcatctttaatcctacagatccaggcgttctacctaaaagttctgcaagcttttttatttctggatttgactggctaattttactaaatggtgttcgacaatataattcatatgctaaaattgtttcttcccggctccattttactccattccgatttgccatattatcttccttatcttaacgtgcttttccaattttgatttatttcttacactcactatacactatatcacatttttacagccagttattttttaatcgcataagttcttacagttcatactttcgctgctttttggcagcattttgttaattttttcattgacattaggcagcgtgcgtgatatactttcacaagaggtgagagtatgcccaatttaggccaatttataaaatccaaaagagaatcttccggattatctttaaaaaaattaagttccgcaactggaatcagcgacactgaaatattaaaaattgaaaacggtacccgtaagaaaccaagctgggaacatctttgtaaaattgcaaaggcattaaattttcacccatttgaggttttgcttagtgctgggtacatatcagaaaatgatattcatccaccactattgatcagcggactggaagatctgaatgagcaacaactcaatacagttcaactgttcgttaactttatcaaaacacaggaaaagacctgtctgaacgattaaggaggctacttatgcaatacagattaggagaattattttgtggtccaggcggaattgcatggggagctacccacgctgatataggcaattctgattattcaattgtacatcaatgggccaatgattatgatgcaaatacttgcgaaacataccggcacaatatctgccctgatgcgccacaaacggtttaccatgaagatatccgtaaattcgatatgagcaagctggcaccaattgacgctctggccttcggcttcccctgtaatgattacagtgttgtaggagaacagaaaggaatggacggtgtatatggaccattatattcttacggagtaaaagctctgaaaagatttaaaccacaatggtttcttgcagaaaacgtcggcggtctgcgtaatgctaacgacggtacggccttcaccaaaatcttaacagaactccgtgatgccggatacataattaccccgcatctttataaatttgaagaatatggtattcctcaggcacgccatagaatcattattgtcggcatccgcaatgacattaatgtaacctatcacgttccttctcctgaaccatatagcgagatagacaacacctgcagaaatgctattgaaaaccccccaatccctgcagatgcaccaaacaatgaagctacgcgacagtcagcgaccgtagttgaacgtctcagacatattcgtcctggtgaaaatgcatttacagcggatcttccgcctgaattgcagcttaacattaaaggtgcccggatcagccagatttacaaaagactggatcctgaaaagccatcttatacagtaaccggaagcggcggcggcggaacccacatttaccactgggaagaaccaagagcattaaccaaccgcgaacgtgccagactccagacattcccagatacttatgaatttcagggaaccaaggaaagtgtacgtaaacagatcggaatggcagttccttgtcgtggagctcagataatctttgaagcgattcttaaaagtttcgcaggtattgaatacccatctgtcgaagctaatatcaatgaataacaaaaagtcggaagtttagcagcttccggctttttattattcatcacttttcttcaacagaaaagtccatatagtactgttcttcatctatcttgtaaaaagtcacatctgttcttccatatgcaagaagatcatcttttttgacatacgctccattacataatccaagccggtttctaaaatattctcccagcaacgcattactggcaggagtggtaattgctttatcattctgctgttctactctcagctgtaacgtgtgatgatcatctgtaactactaaaaaatgctgtttatccaacgggaaaaatccagatttcgcaatatgcgatggcaacggaatataagcctcatttctgtttcttttattcctctgcccccagtttaatccagatctagttccagtttctccgcctcgtgccaagagtgacaaatgcacacaattctcagcatctgtttccatttgttcccttgttgtatcttctgctgaccgcaaaacaacatattcatccacttctgcatatgtgcaatacaccgtccttttctcggcatctgtatatattccatacgcttgaacagcatccgtctcatttacattctctttatcatcatgcaaaagatattgctgcgtaaaaggttctgaaatcttatacgcccttaccggcgtgtctctattcaaccaaatataatagctgttattttcaaatgctggcggatgtgtcaaataactacatgaaaaattcccccatgtgtctgaatatctggttccatgcagttccttaaaactttcatgagatcctttatctattcccttattcaaagtatcaccgataatcaatttgactgtcacatcggaaattccaagttcctcatagctttttagcagccacgaagccatactcggtgtagcttctgctgttaaaatacacagcctgtctgcgccctcttttattggatcaaacagaatttttcctgcaattccatccggatattttaaatcaccgctcatcaagcatcctcctcaatgacatcataatacattgtattactcggcaattttatattcggaacccagagtttctttccgccccatcctttcgttccagttacctgatacatcgtcagaaccactttatctgtaaaagttccacccagctgccagtcattaggtgacagcaatgcacctgtaccctgagcaacatttctttcccggcgtataatcaaaatcccctgtcctgtcggatgctctgacaaaatagtatcgataacagagcagaatgccaggagtttaaaatcaggactcggaataatatgtgccaatatttctttcaccagacgaagactcacctgataatacggctctgtttcagaaaacgcctccagaagttttgatatatcttcaatagaatcattatcaggattaaacggatagtaatttgttcctcctgaaataatttccacgtggtcattatccaatacatttttacgtgttggattaagcccctctggataatatatcttcacatcctcaatgcccttttcaacctgtgcaattatagaattattggtagcatttatatctgcaaacaatttatacaggttttcatcaatgtaaaccttcatcatgcccggatcacgatcatatccaaacattctgctgtgctgccacattgtatctgcctgcggttttttactcgttctcgtatagtaaatagtctgtaatcccggaaatgttacgccacggcccaatgtgtttccgccaacaacgaaattgcagccagcttcataatctgaactctccacatcattctttccattcataacaagaactctgaactgatttccagttaatatttctttaactttagcatacaagtcttccaaagaacacttttgagatcttgacggattcatatctgcgtactgtctgcttaattcattctttaattctgcatcaagattttcaatacaccattttagttccttctgtatatctccttcaatcttcttatgtacagctacccttacgctcggatgaaacaagcagttagatactttaccgcctgacaaaagaatctgagcagacaccaacagatgtcttacaaccacttctctcataggcattttaagcttttccaaaaatgatacacagtccggctttccacttgaagggaagaaaaaatcacctccaagataagcatctcccggctgaaaataatatgtaaaatatggatgccatccagatgcaagcgactgtaaaaagattgcctgcggcgttcctgtcacctgcagatataaactgcttgatgcaccattttttatgctgtccagatatttattaattgaagactgccggtttctgttgaccaacgtatttaatgaagccgcatcagcctcatcatcaatgatgaacagcggatttcctttcataaaacctgttgaattaagaatattcgcccacaatttcagcatccgcacattcttttttaatacaataattacaggatccatcagactgttttcattgaaaagtgccgcatcattttctccacaaatacagaatccatcaagatctgtttttactcgatccagagtttgctgctgaagaacaacattgtctgtagtcagtaaaacaaataccggaaatcctaaatctgccgccttacatataattccaaacatctgtcctgttttaccggattgaacatttcccaacaacagaccaatttcatgactggaaaaagaaaatgtttttatatgcttatttccaacatcatttgctgttttttcaatagattctgcaagttttgtatttcctctatcagttatttttttaaggtaggttttcaaatactgcatatacttttctcctattcatcttcggatcctgctgtaaatgaaagcatccagacatccagcggttttccatcttcatccaatgcagtctgacctgtcttcttgaattccagcctgtcgcatccatattcctgaagcatttcttctgtaatcattcccaggcgatccgtatcaactgccgtattatttactggctttactatacctgccgctgccagccttcctttcagccatcttcccattatcaattcatcgccaactgcactaaactgtttattattatcacttgttgtatgtgctttgaaccaatatccatcatctgtcactacaaaaaatggtttattcttctctggataaccttccatacggtacacatctgcgccaactgtcagctgagtttcataccagtctcttgcctttctcttacttcgcggtgctgcataacagacattaatatttgactttgtataatgctttccatcatccaaatgacgctcatctttcttaggaactttcagtttcagaaagaatgaaacatacgctttacatctttcataaaactcaacatttgattttggtacagatgtaaccagttctattccatttaatgcagtattaacttctctcacaagcggcatattctttacaagcgcaatattctctgagcagttttgcattttcaacttctcaatatgttctgcaatctccgctacttcctgttcagttgttgtaatagcagacatctcgtactgccttctattgcttgcttccaatttgataactccaagatttgcagatccgataattgccgaaaatggttttccgtctttataaaagcaaaacagttttccatgatacttgaatgcctttataactcgaatctcaccagtatctgatttctgccacttttcattgatttttattgctgtatgatacgctccttctggcatgccttcaataaaatacatccctatatttaagcaaactttagagataccacattcatccacaagcctgtctaattcggcaagtgatgcattagaagtatatccaactgcgatttcgactctgtcagctattttcatctgctcattaaagcagtccattattgtttcctgatcatcctctgttcctaatggcagaatatttgaatataataatttcatcctgcaccccctataaactcttaatgtattattcaattttactgcaaaacaactgataatgctaggacataaatgtattttcaatttgtatagtaaattattttcaaagatacaccaaacataaaaaagacgctaccatttctgataacgcctttccaaactatatcaatttgtaatctttcttccacccaactgccatttatcatgtttcttaatgctccgcacagcctgccgcagtgtattactgcggccatgctgatgatacggatgggacaccttatgcttatgaaatatgatacaggatcccatcaatggatattctggattatgtatataccacatatgccttgtattccgggacatgatggttacatcccggtcatccatataaataatctcaaaataccccagatctagacattcaagatcttctctgctaaacacctgctgcctcctttccaaaatacccttccaatgccttctccataatctcctgcactgctccggcatccatctgtgcaaaatacttctcatacaattccaccggcagtttcacagacacactctgcggcttcttcttttctttatacgccagaacaccctcaaccgcctctttcgtaatctcctttcccatcttccgcagttccactgcctgcttcggtttcagtttctttccctcagcctctgccacctgctggatcatcttttgcatcttcacattcagataagacaaatccacagcggctaccattgccagtgttcccttatccacagcatccttaaactccggaatcagccggtctagccgcatgtatctggcaatattccttccagtcattccatattcctcaccaagtccatcacggcttttctgtgacttgtggacatcgtgtccacaggtttcttccagagcctcgatttcctgccggatatcatttcgtttcccctgactgcttatcttctcataacgtgccaccagcactgctgccttctctgatggaagcagttccgcaaaagatctctgcaacaggtttgtctcgattacatatacgtaggcatcctcatcagacagatccgtcttcactatcgccggcacttccgacaatcctgctatcttcgccgcattggttctgttatgccctgcaagcatctcatagccccttgcagccttcctcacgatcaccggattcagcactccatgctccctgatgctctataccatgtcttccaggcgttctccctcatacagccggaatggatgatcatgaaacggatgtatttcctcaacaggaatagaaacaatcccgttcacagccactggcgtatccttcaccggatcctcagcaagaagagccagtgcgtcctgaaatacttttctttttggtgcattagctttcatccccagacacctcctctgccagattccgatatgctttacaagccttattctccggtgcatactccagaagcggctcactgtaataaattgattctcccacctttactgtgtttggtatgatgctcttaaaaatccggatctgtccatcaaaagtatccgtcagctgttctgtgattaccttacagagatttgttctggcatcacacatagtcagcaggatcccagcaatctgcaggcggtcattcagtctgcttctgactttcttcactgtccggcgtgataatcagctgaccattttcacatttcacctgtacataatccccaagatgaaatcccagttcttccagccattttccttttaatgtaatcgccggaactgtctcatatttataaccactctgtccacaaaccttcatatttcttacgtttttctttgccatagaattgactcctttcagatttgactaatagatttttagataaaaagaaaaagccgctgacacgttatcttctaacgcatcaacagcttctatcctgctttaattcagtgtattattcggttttgtaaaggtttatttgctttcagcattctccctgatacggtaataatcatccatatcaatgcctatttttaccttggcatctggttttcgtttgcccaaaagacacacagtctccacatgtgttgtcactaacataggaacacacatcctttacctcgtctacgatatgggaacacatttctttcgctttttctactgcttttgatttcttcccaaatcgttcttttgcgtttccaatttcatttttgaatcctgttttatatatgaaaatgattttatagggatctttctctccattttcatcgtaaccaccgacaataactttttcgatgatactttcaaatattcctctgtcaaattcttctaagatctgattttttgacaatgtttttctaaaatctgccagtcttctttgcaagctgccttcattgtcatattgttgttccaacatacttaactgtgcttttgcttcagacaatttcttttcataccccacatctgtttcctcataaatgtctttagctacaactccctctaaatagttttccagcaacttttttctcttatattgaatattataaacacttctattgagtttttcaattttatcttctatcgagtcctctgataaagttttctcgactctcttaataaattcttccaacacatctttatgatctgtacataacatacggtaagattcaataaaagcatcttctataacctgctctggaattcctttactatctggacaaaaccttttaccatgttttgttgattctacacattgccaaatagtttttgtatatttcgaactgctatgccaccttctccttgataaattcgcaccgcaaaatccacattcaagcatacaactaaaagcatattgtctactgaatttttctcgttttccaggtgctactccctttttgcgtcctccattacggcgttcccgtatctcctgagctcttgcaaatttttcttctgatacaatcggttcatgatgatttttgatgtaaaaccgatcttcttctccaagattttccagccttctttttgatatcggatctactgtaaaggtttttcctaataaaatatcacctttgtatttttcattattaataattcccattacactggaagaagtccatggattccctttaatagttgaaattccctgttcattcagttctcttgcaatcatcgtacttccagcacctgcaacatatctatcaaatatgtatcggaccgtttccgcaccttcttcgttaatagacagcgactttgttactacatcgtaatcatatccaaggcagccctgaaaaccaacaagttctccacgtttcatcttcattttcaaacctttttttacatatgcagatgtattttccacttcctgctgtgcaacagaacttaaaatagtcagtaaaaattctccatcttttaaggtattaattttttcgacttcaaaatataccgctatattcctctctcttaacattcttacatattttaatgtatctaatgtatttcgtgcaaatctaggaatgctttttgcaatcactagatcaatattgcctgaaaggcattcctgaatcagtaattggaattcttctcttttatctgttttcgtgcctgtaattgctttatcagcaaaaactcctgcaaaaacccattgcttattactctttatcaagtccgtgtaatatctgaccattgaattataacttttaatctgatcttcatcatcagtactaacacgacaatatgcggcaactcttaatctatcaatctttcttcccgtagaagtatcctcaccagcacccttcgccttaatgatttcaacttccatttcaccgctcctttctttttgtgttcctaccgtagtgttgatataatcttacaacgcaacactccgatagtcaagcggtaatattagaaataacaccataatctttttttaactttttctctaccagctgatactctgcttcacttataagttttaacgagcgtaattgtttcaacattgacagctgcatacaatatggcaaatagcaccattaatccaagaagtacccatggcaatgcagccgaaataaaatcaatgaacggattgccgtcaaatacattaccaagaataatcataacaacaccgattacgatagatatccatacaaatttgataacgttattttcggctttggctactttcatgtctctttcaattttattaagcaatgtcgcatctcctttcaataattcatccaggcttaaatcatataattcactcattcttataatgcttacaatatcaggtagtgattttccattttcccagttagaaatagtctgcctggaaacattgaggtcttcagcaacctgttcctgtgtaagtttctttatagtacgagcatttttaattttatcagctatcataattctgtatacctcctttcttccatgagattacagcaaacgtagtagtaacgtctatcaaaaggcttttacatattagataaaatcatgtaaaatttcttttacatagcttaattgcagtctatttagcttgtttcttgactactcatgaaaaatatttttactttcgccccacctgtattttcagaatttgaaagtttaatccctccgccatatttttcagccacagtttttgcaaaaaatagcccaatcccataatgggcttctccatttctacttgtgtcatccataaaaaactgctctgtgccatgcaataatgcttcttttgtaaatcctgatccactatcctccacaatgaatgtcagccgaccatcatgctcctttgcaccaatataaatgattccattttcttttgtatgctccactgcattctgaatcacattcattactgcccgaaacatttgatcatagacaatcattacctttttatcactttgctttgccttccaatctattttctggtgatagatttctgccagcccaagtgcctgctcctttatatctgtaaaaaaatcttctaacatcaccgttgtataggtaacatcactgcaattccatgattttgtgacatctatcaactgctggacataactttgtatctgtgttgtaccgtttaaaacataggtaatattatttttctgttccgtggtcagttcagtctctgaaagtagttctgcatttccccttacaatcgtaagaggtgttttaatatcatgcgccaaaacagacatctgctggttcttttcctgctctgttttccattgcttttctaaggattcccgcaatgcatctcgcatatcatcgattgccgataaacaatcatcaaactctttgataccggaaccagatgtcccatactccaggttctgattctttatttgatcgatggcatctaacacaggctgcatctgctttttgattctttttccaaaacatatggacggaatgatgataatcgctatcgctccaatcacagccataatactcatcacattctgaggtcctataaaatgctccctcaaaaaagccgaatgatactgaggtgtcaggcgatattgcaaaacaacatattcattttcccttgaaattactttataaaaatatttcccggatgcggttccatactttgcaacattccatgctatctgttcgtattgttctggaagatttccacctatttcctctcccttctctgaaaaaatgacataattacaaagtgcaggaatcatctcagcagtcactttatctgcatgcaaaatcgtatcatatgcttcattaatcttttgctctgcataattcgccggataaatgcagcccacactgatcaaaaggtaaagtagcagataagcaacaatcaccaaaccgactaatgatccaagcatgacaagtacatatctcataaaaatcttgctgagtgcattgcttctctttactcttcccatttatatccaatcccccagactgtttttatcggtgtataatcataatccgcaaattttgctcttatatttttgatatgcgtgattatagtactgtcattactctcattgtcaaagccaaagaccgcttccaatatctgttccttcgagaaaacctgtcctctgtttttagccagaaattcacagatttcgtactccgctttcgtaagaggaagttccttatcatcaaccaatagtttcttttgagatatttgaatacagaccctccccaaaaccatccggacagaatgttccctgtgctctcttctaagatgtgcattgatccttgcccgaagttccatcactccaaatggctttgaaatataatcatctgctcctaaagaaagtccgtttaccagactgttttcctccgtttttgccgtaagaaacaaaatcggacaatccacaagtatcctaattcttttgcataattcgaagccatcaattccaggcatcataatgtccagtaaaatcaggtcataacgatgtaattcttccatattaatttttagtggattacttactttggtaaccagatgtccatccttattcaaaatgctttctatcatttccaaaattgccggttcatcatcaactgccagtatttttgccatagtttccctcgattctattccgatattctgtttccttcccagtggtttacccaccaaaaatagtataccatactaatccctgtaaatattaagcaacctggtatgaatgacaaccattcacctacactagtttctcccaatacagattgcagataagtatatggtactctacccgtccagcagacaaatacatatttccacacataatctccaagtccggtaagcatcaatgcactaattagtcctgatataatccctgctccaatggataccccttttccaaactgaaaagccagaatcagctgccacagataaagtggaacactgcttccccacagcagcaatgctgcaaatatacatcctttcatgatttcgatatcgcttgatgcgattcttccaaatccaattccgaatatgattgctgtcaataggatagagcacagacacaaaaccagtagcatcaacagtttcgataaaaatgctgcaggtttatccggtaaagacaacagattttgaaaatcacctgtattttgttcctgttccatcacacttgctgtaaaaattccaataagtaccggaagtcctgctcctattgcctgataaaatgcaatcactttcatattttcattccatggtgaaaaaaagtaatatattaaaaatataacgctggttataatcggaatcagtaagtgtgccagaatcacagatgttcctttcatctttcgcaagtctgcattaagagatcttccaatcatcttatttcacctctcttctctcaaaccatttcaaaaacagaaccgttacaaaaacaaaccagatgattgagagacacattcccggaacaatgactcccgtatccaaaagaggattccctgcttctgcggcaagtccatttggtaaaacatgaagcaacgggcacatcattcgcatagggattgcagaaacaagtacataccagattctggtttgtgatattatcacaccgctgacggtaataaacaggcagacgaacaggtttacaatcattccaaatcgttcacttaaaaataaagctaccggaatctcccataactcagaaaccgtcagaaacaatactgcaatcaacgctcctccaactggaacatgtgtcgttagaagaaagcctccaagcgttgctcctgcaaacacaatcacattagaaaacaaaatcatgtacccaatataaataattttccccagcaacaattttcttctgtctgtgggaatagtcattaaatgatagtattttatctttttctcctgcgccacagaaagataacaaaatagagcaatcatccccggcagcaaaagtgtataccaccagttccaaacactttctgcataagcatttgtcatcccaagagtaaatataaatgccataacaaatgtaagaagaggaaatccccagataaacttttttcgcatggttcttttggctttttgatgttctgcttttataatattaaccatggatttcacctgctttctggttttttcttaccacattcataaacaaatcttcaagattatctccctgctttaatgctccttcgtatcctaagattccacctgaaataatcccgactttatctgcaagtaactgtacctctgagagaatatgactggagagaattacagtgattccctgttccggaaaagaccggatcagctctcgtaattcctcgatgcctattggatctaatccattcgtaggttcatccaatatcaaaagttccggttctccaagcaatgccattgcaatgcctagtctttgcttcatccccaaagaaaactgtcctgctttcttctttccggtgtttgtaagtgatacaatctgcaagacctcatcaattctgttttcatctgtaccaagcaataattgtcttaccttcaaattctctctggcggaaagattttcataaataggcggattttcaattaacgctcctatttttgataaatctttcctatccaaaagttttccatcaaagtaaatctttcctgcagttggtttcatcataccagtcaacattttcaatgtggtagattttcccgcaccattcggtccaagcagtccataaatctgttccttttctatattaaatgaaacattatttaccgctttctgctttctaaaatatttacacaaattttgtgtctgcaacatcatttccatctttactatccttccttccatatttcatttcttactgaaatataacctaacagaaaaaaataaagatttgatgaagattgctaaataattcgtctactctatttttattctcgtatggaataaaccatcaattgaatatcattatcagaactcggctttccactgaaatcagcaaagctgttacaaatacgaagtcctaatttaccgaatatctccgtgatttcatccaaactatataaccttataggatttccttctttcatttcaggcttataaagtgcttctccatacatatagtctacctgcccatatatcagcatttttctatccttctcccattcaaaagcagataatgtaagtcccttttctcctgcatcccataacttgcaagggaaatgtgtttgggcatagcttccattcatgatatccataaagtgctttccaccattttttaatgctttcgcaatgacagaaaaaatcttatgattttccccatcgtcttcaagatatcctattgctccatccgccatattcagcacaacatcaaattccttatcaaatgtgatcgtgcgaatgtcctgacaaatgaactttgcattcaaattttctttttttgcctgctcgtttgcataatctatatacgccggtgtaatatcaataccggtaacatcatacccacgtctggcaaacttcagtgagtgccgaccaaatccacatgccaaatcaagtattttttccgtcccttttaactgcaactgattgattagaaaatctacttgtctgttggtatcttctacccatgacatattgtggatatccagagtccaatttttctgataccagtcttttttcattgctttcatctaaatttatctcctgcctttcatccttcaaaaatctgtcccggtagttttttcttttctaaatatggaaacgctctatcaaattcttctgcttcattttcatccaccagataccctgctggtgttgcatattcacctgttatgccatctagataacccgaaatcagttctttacataaaaagaatgaagcatcatccccttcttccagaccatggtaacgaataccaaattcacttgcttgtttaaatccgcttttcccataaaaatcaatatttccttcaaaacataatgctccgcatccaagttcttttgctttttctaaagaataatccagtaaaatctttccataccctttccttttaagctccggtgcaatacagatcggtcccatagtcataatgggaatacttctgccatcatcggctacaatcacagccttcataaacatattctgtccaatcagatgtccatctaatgtcataacaaaatccaactctgagacaaatgccgaatcattgcgaagctgatggagtacataatgttccagacagcctggtcgatcctcccagtctttgtaaaagcaatactctggataacggattttaatggcttcccagaaataccgggcatatccacagcaaaacagatcctctacggtataacactgacattctttcaactgatcttcttctgcttcgtaatctccgacgcttggtgttccattacaatacaggttaaatgccatacggacaattcgtaaacttccactggtctgccacccttcctgcaggcattccatttttacacatccagttttaaaattatagattttattcacattatttcttgtgtctctgtcgatacccaggcaataaaccaaaacccgatggtagacatcctgatatctgcattttttcagatattcctcataaaatttttcgtgttccctgctcttgaaagtaattgtgcgagaattgctattctctgctcttaacgctgtgtttgtcattttcattttcctcctgaatttttaatattttggtataaaaaagacactccatttctggaatgccccataaaaaatagggacacccgcttttaacaagtatccctataatctatcaatgatctgatagctctctattcattttcatatttaagattctttgtgttccccgtcccgaggtctaacgcaacaacaacggttactttcttcacaaggctcttttctttgtgattttcacctatttttttgaaactgaaaaactccacaaagtgcgtaaattcaaggatttctaggtatctttcctttgtagtcctaccacagtctccacatgctcggtccaactaaacatatcaactggcacagcgctttttgcctcatatccatgtttggttaaatattttaagtctcttgcaagtgtttccggattacaggaaatatacaccactttttcaggtgcaagtttaatcacagaacttaaaaatgcctcatcacttccggctcttggcggatccataaatacaacatcgactttcttgccctgtccagccagatttaccatgaattttccggcatcaccctgataaaatctcacatttttaattccatttcgtttggcattgataatcgcatcttttacagcgtctttatttaattctacactgatgacttcttttacatgactgcttgcaatcagaccaatcgttccgattccgcaataagcatcaatgactttctcttctccctgtaatttcgccattttaattgctttttgatatagtttttcagtctgtactggattgacctgataaaacgaagccggagagaggcggaaagtacaaccgcaaagcgtatcttcaataaatccttttccatataaagtgatattacgttctccaagtaccatgcttgtctttttgtcgtttacatttaaaataaccgttgtaatttcaggatgaagttttctaagagctttcacaaaattattttttgatgggaagattggagaagcacatactaatactaccattacctcaccgcttgcaaatcctctccttaccatgacatgacgtagtaacccatatccgctgtcctcgttataaacttttatcttaaaagattttaataagcctcggatatctctgataattgcatccgcagtctggtcttctatcagacattcatcaaccggaacaatacgatgtgttccttcttcatagactccggaaacaatactgccatctcgtctgtgtgcaaacgctgcattgactttatttctataatgatatggatttttcataccaataatcggttctaccagacagatatctttcaaaagttttctgatctgcttttgctttttctttaactgttcttcgtaagaaatcccctgccaactgcatccgccacatttttttgccactggacatactttttgttcttccattttataacaactccaattttatttttttgtttcattatatcagatttcctctttgcttaaaagctatgttattctgtactttttttacaaaatatgctattattttattttgtaaacttttataaacctattaaaagagaggaatacaaaaatgctccaaacaattgaagcagttaactctgctgtaaacaactttatctggggtgtgcctgccatgatttgtatcatcggtgtcggtctttacttaagtatccgtacccgatttttgcaaatccgcaagttcccttatgcaatcaaaaccacaattggacgtgttttccgtaaaagagaggcttctgatggcgcaatgactccatttcaggcagtctgtacggcacttgccgccacagtcggtaccggtaatatcgccggagttgcaggtgcaatcgcaatcggcggtccaggtgccgtattctggatgtggatttctgctgcccttggcatgtgcactaaattttcagaagttacccttgcagttcacttccgtgaaaccaacgcacggggagaactgatcggcggacctatgtactacataaaaaatggtcttggaaagaactggagatggcttgctgctttattctctcttttcggtgtcttaactgtattcggcaccggaaatgctacacaggttaatacaattacgaccgccatcaattctgcattattaaattatcatcttatcaacgaagatgctgtttccaccagcaatctgattatcggtattatcattgccattttagttgccactgtacttcttggaggcgtgaaacgaattggacgtgtaacggaaaaactcgttccatttatggcacttatttacattgtactgtcccttggtgtgattttattaaatttaaaccgtgtaccttctgtttttgcttctattgttgaaggtgctttttctccggcatctgtaaccggaggtgtggtaggaagcttcttcctgagcatgaaaaaaggagtctcacgcggtattttctcaaatgaagcaggtcttggtaccggttctatcgcccatgcctgtgcggataccaaaaaaccggtaaaacagggattcttcggtatctttgaggtttttacagatacaattgtaatctgtactttaactgcactggttatcttatgcagtggaacccctgtcggatacggagaagcagccggtgctgaactgactatttccggctttacttctacttatggaaactgggtttccattttcactgcaattgcactctgctgttttgcattttccactatcattggatggggactttatggtgcacgttgtattgaatatctgttaaaagaaaaatctatcaaaccatttatggttgcttattctctggttgccattatcggtgcaactgctgatttaggtctgatgtggagtgttgctgagacctttaacggtctgatggcaattccaaacttaattgctctgttcttactttccggaacggtggcccgtttagttaaacagtattttgaaacagaaggaaaaaccaattagttttttcaataaaaaaagccgaaagctttaaggggttaccttaaccctctcagctctcggcttttttcttactcttcccgttctaattgtttcagcagatatcttcctacaatccctgaaaatcctgccacatcccgaatataggcaaaatcttttccaaagatctttttttctgccggtaaatctttctcttctcctgcaaatactccaagcacacaaacacctttacttcgtaatttacgtacttcaaatgcagtatctgaaatcgcatactttccctgatagggttgtggatttcttgcatttggacggtttaaaatcacatcataaggtcgtccgtcacttagtacaatcagaatcttatgttcctcttcccgatttaacaattcatagcctgctgccttaattgccaacccatcgcggttattggaagacgtattatattcaaaaatattttcattggcacttctatcatcttcatattcccgaaaacggtgcaaaatcgtataatcccagaaggtgcaaaaactcataacccgatgtggaacatttgcgatgctcaatgcttcacttaaaatatatgcctgcatcgccacctgcccctgccgttttctctgtgagccacttgcatcaattaaaacatccactacaaaatcactgttatcgtaatttagttttcttaaaaacactcttgaatcatgacttcttccaactctccaaagacgtgacggcacaattcttcccctgtcagatattgtttcctgtacttcatcacgcatcaccagtgctttttttagcatatctgagagctgtcggatgttatttttcaccatcctgtgattgttataatattcatagcggtttttatctcgctgtttttttgcatactcatactgataattacgaagaaccgcatgttttaatactccttctgtaaaatacagactacagtcactatgaattccacgacataataacaggtttcgtcttttctcttcagtttcagaaagatatccaattccgtaatttcgctgaacgtaactgtgcatcttagaaagtgcctcttcatctacaaccaaaattttctttttctgacttgtctcttcttcggattcttctttctttgtctcctggtttaattccattttatccaaattggtcattgcttcatttatatgttccagataggtgccaaagctctcttctaatgcctcttcttccagataatctttccaggaaaactcggcaagctcttccagcgaaactgcaagtaccgtttcaagatttccataacgtttttcaaaattaggatctaccatagcgttatataacttatctatcgtgtgaatcagctctatcgtttcttttgcatcagaaagtgcctgaacctgttccataaatgctctcatccggtttgtagcaggctcagaaccgtttaaacattctttaaacagcattagcttcaaacgccctggctcagaagctgcaaggcgtgaaaaatccatttccagtatatcttcaagcgccttttttcggatttctttgactccttcccgctcctttgtaatccgctcggctaccgaccattcaatacaaagctgtgcaaggctcataagaggtccttcttccccatgcagatagattttcttcattaagtataaagaaagctcttctctgttaaaataacgtgcaaatgcgccctgtttgattccgtcataaagcccaactgcatgagaacgatgataactctcaatgtccggttttacatccagcgtataatctccacttaccgtccaaatcagatttttgatccggttttctaattccaactcaaattcttctctcattcaaatacatcccctggattccaggactccggtattcttgtctttacgacatcctgcacaatttccttctcaaaaatatcaaagcatttatttacaactcccattttcactgcaagggacggttttaatccgcaggaaatcgtgcgcagtgccccaatcatccctcgcaaatccaatgcttttgttgtaatctcgctgttatctgcctttaactgcaaatccaagaagagtccaatccattgctttaacgcttcctctttgatagttggaaatttcgttttaaaaacgtactcaagtgtctcttcattctgacccggcatatctatcacaaggaagcgggaaactaatgcttcatttaactcttttgttcctgcataaccataattcatcgttccgataaaacgtgttgcgtcgtccatctcaattttatcatatcccggcacatcaatacttcttctatgatcgagggtagcatgtaaaacggagactgcatcattttttgccatattaatctcatcaaggattccaaaaccaccatattcggcacaacggtagatacttccttttcttaatttgacttcattattttcaaaggtatctgtaccaattaaatctccactgtctgtattgacatgaaaggaaatattataaaccggtcttgcgaaaatccatgccagattctcagccagtatgtttttaccggttgcctttggtcctgttaagagcagattttctccctttaataaagttgcaattcccatctctaatacttcttttccaaaaaatgccatatctggctttataatacggtttttcaccctctcatccactttatgttccgcacgaaattctgcaaccgcttcaatcaatcccttatctactttttgttcctctaaaaccttaagttcttgttccattttctccatcctgtatttttttacttttattctattctatttcaccatatccatctgttggatttccaacatttttgaaaatcaggcgctacacttatcatagaataaatttttcatataactagaaaaggcatctggattttccaaataccctttcttttttctcaatttctatttttatacatcaaataataaatcaccataagatggcatcggccacatatctttgtcaacaatcatctcaagttcatcaaccggtgtacgaagtgcttccattgacggcattactttttcatgatagaacattgcactttcttttccttcttctttggtcagtgcttcttctgttactttctttaattcatttaatgcatcttttgttttctttaataaggcagaagtttctcttaagagttctgtctgtacttctacttctaaaacacctgctgcaacaaccgcattaatagaatctgcaagctgtcttgtatatttaattactgccggaataatctgtttgcttgccacatcaatcatagtcttagcttcaatattgattgcttttgagtaagcttcgtatttgatttcttttctggattccagttctgcttttgtaaatacaccaaatttttcaaacaattcaatggtctgttcgcttgtcagtgcttctactgcatctaccatacatccgatgtttggaagtcctcttcgttttgcttcttccacccattcatctgaataaccatttccattaaatacaattctctgatgctcagtaaagtttttctttatcaaatcatgtacagccatatcaatgtcttctgcattctccagtacatcgcagacttctttaaatgcttccgctacgattgtatttaagacaacatttgccggtgcaatagaatctcttgaaccaaccatacgaaattcgaatttattaccggtaaatgcaaatggtgacgtacggtttctatcggttgtatcacgcataaattccggaatggattttacaccggtctctaatttttcacttccgatactgtggtcagccatacctgttgtaatcagctgattcataacgtcagtcagctgagttcccaaaaatacagaaataatagccggaggtgcctcatttgctccaagacggtggtcatttccaacatcggctgcagactcacgaagcaaagctgcatgtttatctacagcttttaaaatacagcttaataccagtaaaaactgcacattttcatgcggtgtatttccaggctctaacaaattcacacctgtatctgttgtcaaagaccagttattatgttttccggaaccattgactcctgcaaacggcttctcatgaagcaggcatttcattccatgctggcttgcaacacgttttaaggtctgcataataatctgattgtggtctacttccacattgacttccgcataaatcggagctaactcatgctgtgccggagcaacctcattatgctgtgttttagaagttacgcccagtctccataattcttcatttacatgtttcatatatccggagattttctgacggattgttccaagataatgatcatccagttcctgaccttttggcggcattgcaccaaataaggtacgacctgtgaaagtcaaatcttttctctgcataaatttcttctcgtcaaccagaaaatattcctgttctgcacctacagaaggaatgactttttttgcagttgtgtctccaaacagacggatcagacgcattgcctgtttatcaattgcctgcatcgaacgaagcagcggagttttctggtcaagtgcctctcctgtataagaacagaatgcggttggaatacataaagttgcccctgctgcatcatgtcttacaaatgccggtgaagtacaatcccatgctgtatatcctctggcttcaaatgtcgcacgaagaccacctgatggaaaagatgatgcatccggttcacctttaatcagttcctttcctgaaaagctcataaggacttttcctgatggaagcggtgcagtaatgaacgaatcatgtttctcggctgttactccggtaagcggctgaaaccaatgtgtataatgtgttgcacctttttcaatcgcccattctttcatctcatgtgcaatgacatctgccatctcaagagacaattcttttccctccagaattgtctgttttaattccttatatactttttttggaagtcgctgctgcataacagaatcgttaaacacatcttctccaaaaatttcagtgactttaatgttttcactcattcgactatcctcctgtattatgtgcctaaaagctgtttctacgatacctcatataagaaaaaaaagcaagtggaattttcagatatcgcttaccaaaatgcaaagaaagctaaaagtaaaagacaaatcccaccaatccaggacaagtcttttttataaaactttgcacagcattttccaagtttccacccgatttccatcataaaaatcccaaaaagaaatgcccctgcaatcagcatccagcgtactccctctaaaagtcctgctcccatcccaactgccacactgtcaatagacagtgccattgccagaataatcccactcataaaatttaattttcttgtttttttcgtcgtattttgctttcgtatccgaacagagtgataaatctgatatccccccattccaccaagtaaaacccctgccagaatatctgttgtcctgccttcgataaaataagaaaaaccatttcctatccagaccgccattcccaacattccgctcataaccagattcatccctgcaactaccgaaaatgaaattttaatacggcttgccccatacgaaaaactgaccatgaatgaatccatggtcagtgcaaaaatcaatatactgtttttcaaaaaatcctctatattcatatccgttcagcatccactttttttattatactatgataataaaaagaaaaagtccgatgccttttacgttttatttactgatacagcataaattaagcagctgctatattgatgccaagcgactttttgctatacaaggcagaaaaataaaacatcagacacatcaatatggcggttacttaatattctctgtattagcctgaatcaacggcactttctcatcttttttcaatataatgttcaccgcatgattcatattttggatttccacctctcgatgttctccaccaaattctccatccaaagtccaggaaatctgtgtctccgaagtaattttaaggtaagaagtcttaaaagactcaatgttggaagtatccgctcctcctaaaagagctgtaataatctcatttaactccagaatatttttcggacgacgtatcagtaatacttcaaacacaccatcatccagcaatacatctggtccggttagttttcggaatccaccaacggatgtcgcattgctgaccattccgaaaataaaatctccctcgaaactggtatcctttgtttctaccttaagctgataagaagcaatattaaataatctctgtgttccttctaatatataggctgcatgtcctaaaatattttttaagtcctgattagtctcataagaaacatctgtaaataaaccaaatgctgcaatataaacaaaaaagtcatcattaaatttcccgacatcaaaagcatgtggaatgccctctacaatatctgtagccgcctgtaacatattttttgaaacatgaagactatttgcaaaatcattcgtactacctgccggtatgtaaccaagtaacgttttatgatttccctccatcaatcctgttaccacttcatcaagagtcccatctcctccacttgccacaatcaggtcgaaatcccctgctctttttttcgcaacccgaagtccatcctgatatgcctgggtagaatgtactgttacctcatatccgccttttataaaaatatctataatatcaatcagacgtgatttaatacttccttttcctgctcttgcattaaaaataaacagtaattttttttccatacgtctttctcctatagaactttacttttctaattgatagaacaccactttgtacaagtataaaatcaggacaatacaaaaaagaacatacaattccggtgcagccatactgttaccggaggtatgttctttttacttcagcctaaggctgcattatcttttcaatttgtccacaactgaaattatactaattctaatacaacttccattgctgcatcgcccttacgtggtccgattttgatgattcttgtgtaaccaccgttacggtcagcgtattttggagcgatttctgtaaacattttatctaccatgtctacatcttttgtatttttctttctaccagcagcagctgttggaacttcttttaccgggtagaaaacttttaacatctgtcttctggcatgtaatctggacggagcatcttttttgatttctttctgaacttcgtcatatacagttacttttttaccatcaacaacttcttttactctttttccactttcgtctttacgagcaacttttgcagttactgtaacagtttcaaaattgtctttttctttcactgccattgcaataagaccttccgcaattttgcgaacttcttttgctctggtttcagttgtaacgatttttccatgatataacaggcttgttacctggcttctcagtaacgcttttctctggtcagatgttctacctaattttctatatttagccattttaatatttcctccatttgtggaacaatgagccatgcttcttcggtcttactggctcattgcttatattccataaattctctttacttggtttactcatcacttgggttcaactgtaaacctaactcttttaattttgcaagtacttcttcaagtgatttacgtccgagattacgaactttcatcatatcatctgaagtacggttgcaaagttcttctactgtattaatgcctgcacgttttaagcagttataagaacgaacagataactctaattcatcaatgttcatttcgagaactttttctttttcattatcttctttctcaatcatgacctctgctgtttttgcactttcagacaggtcaataaagaggcttaaatgctcgctcaggacttttgctgcaagactgactgcctcatcagcatccaaagtaccattggtataaatatccagtgtcagtttatcaaagtctgtaacctgtccaacacgggtattttcaacagtcatatttacacgctctaccggagtataaattgcatcaactgcaatcacaccaatcggcatgtcgtccgtttttcctttatcagagctaacatatccacgaccttttgtaattgtaagttctgcattaaacttacatcctgctccaccattcaatgtagcaattacctgatccggattcaggatttcaatatcctgatctgcctggatatctgcgcccttaacaacgccttctccatcaaactcaatatatgcagtttttggttctgcgctgtcacttgtgttcttaattgccaggtttttcagattcatgataatctctgtcatatcttcttttacacctggaatggaactgaattcatgcagaacaccatcaattttaacctggcttacagcagcacctggtaaggaagaaagcataattcttcttaaagagttgccgagtgtaataccataacctctttcaagtggttccacaacaaatttcccatatctcttatcatcagacatttctgtgatttgaattttgggtttgttaaaatcgaacatgcaaagccctccttgctacgtgcatcttatttagaatataattcgacgattaacatctcatcaaccggtacgtcgatttcttctcttgtaggaagtgctttcacttcgcctttcagagcttcctgatcaacatctaaccaagccggtacaagacgtccgcctgttacttccacgatatctttgtatctctgggaagatttacatttttctttaatttcgataacatcgccaacttttacaaggtaagatgggatattaacctgttttccgttaaccattacatgtttgtggtcaacaatctgtctagcttcttttcttgttctggcaagaccaagacggaaaactacattgtccagacgagtttccagcataatcatcaggttttcaccagtctgaccctgtttctgatcagcttttttatagtagttacggaaaggtttttccagaacaccatagatgaattttgctttctgtttttctcttaactgaagtccatattcggacatttttctatttgctctttttaactgtcttgttgattttttgtcaattcctaaataaatcggatcaagaccaagggatctacatcttttaagaactggtactctattcactgccatgattaattaacctcctaattagactcttctacgttttggtggacggcaaccgttatgtggtaccggtgttacgtcgcagatgcttgtaacttccagaccgcaggcagacagcgcacggattgctgcttctcttcctgaacctggtccttttacgaaaacgtcaacagtcttaagaccatgaattaatgctgcttttgtagcagtctctgcagccatctgtgctgcataaggagtagatttccttgaacctttaaatcccagaccacctgcacttgcccatgataaagcatttccttcagcatctgtcaatgtaacgattgtattgttgaaagatgactggatatgtgcctgtccgcgttcaacgtttttcttaacacgcttttttgtcactttttttgtaactttagccatttctaaactaacctactttctcaaatatttcaaatcatcatgttatcatttgctttaatttttcatctaaaatttaaagcttaattattttttcttattagcaacagttctcttcggaccttttcttgttctggcatttgtttttgtcttctgtccacgaacaggaagtccttttctatgacggattcctctgtagcatccgatttcctgtaatctcttgatgttaagagcgatttctcttcttaaatcaccttctacattgatgtttaattcatcaattgcatcacggattttaccaacttcttcgtcagttaaatctctgcaacgagtatcaggattaattcctgcctgctctaagatacggtcagcacttgttctaccaattccgtagatataagtcagaccaatttcaacacgtttttctcttggtaagtctacaccagctatacgagccatgtacttgttcctccattgttctaataaatattgttcctaattgagacacattgaaaatgacggtttcatgtgtccagccgcaaataaatttcacgcagcctttccgaatcatacagtccggtattaagcaatattctgcaatcatcctctcggtaggacgacaaacgtgataatattactatatttaatcagtataaacaacgcatccacgtggttcatactgcagccgcactaaaataaaactacacaaacttttcctcgtctaattaaccctgacgctgtttgtgtttcgggttttcacagataattctgatgctaccttttcttttgataactttgcatttttcgcaaatcggttttacagatgctcttaccttcacggaataaccctcctttcgtatttttgctgtgctctgattcgagggcaaaaatgcccgagcacaaaagtacgctttatataatagcactacttacataagattgcaagtgtttttttcaaatttttagctgcatatctttgtacttttttcagtacagatatgcagctattcttgtctgtaatcttatttatctctccagataattctgcctttgctcaaatcatacggagacatttcaattgttactttatctcccggaagaattcgaataaagttcattctcagttttccactgatatgagccagaattacgtgtttgttttccagttccactttgaacattgcatttggtaatttttccagcactgttccttctacttcaataacatctgcttttgacataaatcaaacctcctgtccgcttttgcggtttttcaatactctcttgatacgctcatttgttaattcatttccctcatcgagaagcttctggatttcgggagcaatttcataggcgacctgaatatgttttacttttttctttttctggttttcaattgtacggatttttccgtctgccagataaacatattcaccttctgctttcattatcatgtatctttttcctgtatcatgaccggcaagtgatacagccgtcattccggttccaagttttttcattaaaccgaacctcctattttgtaaaagtgagaatttccggctcaccatccgtaattaatacagtattttcataatgtgcagaaagggagccatcctctgttacaacggtccagtcatcatctaaccattctacatcggctctgccctgattaatcattggttcaatcgcaagagtcattcctgcctgcagtttcagtcctcttcgtctctgacggaaattcggaatttcagggtcttcatgaagacttgttccgattccgtgtccaactagatcgcgcacgactccgtaaccgaatttttctgcataagcaccgattgctgcggagatttcatataaatgatttcctgcttttgcaaatttaattccttcaaagaaactctgtctggttacatcaatgagctgttgtgcttcttttgatattgttcctacagcatgtgttcttgctgcatctgaatgatatccctgataaatcagacctgcatccagacttacaatatcaccatcctgaagaattctgtttgcttttggaattccatggactacttcatcattaactgagacacagatggatgccggatatccattataatgaaggaagtttggaatacatcccatctgacggataatcttttcacctaactggtcaatctcaagagtagaaactcctggacggatgaagttttcaagttcatcgtgtacctgctctaaaagccttccggcttcacgcattttttcaatttctctggcagtttttatcgttactgacatttttacgctcctaaaatctcgacgattgcttggaatacatcttccatatcaacagtaccgtctacttcttttaacacaccggatttagtatagtaatcaattaacggctgtgtctgatcatggtaaactccaaggcgtttctgtacagtttccggtttgtcatcgtctcttaacactaatttttcaccgcaggcatcgcagactccatctacttttgtcggattgtatttaatatgataagttgcaccgcatccaacacaggctcttcttcctgacatacggtttacaatgttttcatccggaacctccacattaattgcaaaatccactttttctcctcttttttcaagagcagcgtccaggcattctgcctgcggaatggttcttgggaagccatctaagatataaccgtctttacagtcatcctgtccaacacggtcaattactaaatctaccgttaattcatccggaactaacagaccctggtccatataagttttcgcttttttaccaagctctgttccatttttgatatttgcgcggaaaatatctcctgtagaaatatgaggaatgtgatatttttctgcgattttctttgcctgtgtaccttttccggcaccaggtgcccccaacataataattttcatacgcttttccctttctgtaatgcttttttactctttttttacattttccttatatagcattttagtgcacccacaaaagtgggtacacttccataatgttatgcctattcacttaaaaaacctttataattgcgtaccaacatacgtgattcaatttgtttaagagtttccagtacaacaccgactacgatgatgatggaagttccgccaaatgaaacatttgcaccgaatacaccgttgaagaaaaacggaataactgctacaattgtaagtccggcagctccaataaagataatgtaattcaagatattctcgagatactcctgtgttggctttccaggacgaattccaggaataaagccaccctgctttttcatgttatctgcaacttccatcggattaaatgtgatagaagtataaaaataagcaaagaaaataacaagtacgatataaagaataagaccaattgaatataccggttcatccggattaaaccaattactggaagaaagtccttttaaaatcttgcttccgattcctgtaccgttgcctttatttaaaaagctggcgataataaccggaaaagacatcaaagaagaagcaaaaatgattggaataacaccggcagtatttactttcagtggaatattactggactgtccacccatcatttttcttcctaccattttcttggaatattgaactggtattcttctttctgcaccattcaggataagtaccataacgactaccagaataatgattgccgctataatgattactgacaaaccacctcttgcgatggttttgccttttacgaatttgtcaaacaaagtaaccaaatcacttggtattctggaaacgatgttaatcataagtacgatagaaataccatttcctacacctttttccgtaatctgctcgccaatccacattaacatagcagaaccggctgtcaaagtggcaaccgcaacaactacgcttgtgaaattcatgtttgtaagccatcctctgtttccaaatccgattgccattgtaacggactggaacagcgctaaagctattgtcacataacgagtgatggcagtcattttctttctgccctcttctccatcacgctgcatttcttccagcttcggaatcgcaatcgtcaaaagctgaatgataatggatgatgtaatgtacggtgtaatactcaatgcaaaaatagacatggtctcgaaagacccacctgtaaatgcattgaaaaagttaaacgcatcgtttgactgatttgcaaacaattgtttaaagaaatctctgtcaacgcccggtattggcagctgtgagccaatacggacgataacaagcattaacactacatagtaaattcgacgtcttacatcttttatcttaaaagcatttttaagagtctcaagcattagatcacctcgacagttccacctgcagcttcaatttttgttttagcgctttcacttacagcgttaacttttacattaactttctttgtaacttcaccgttaccaagaagtttaacgccatctccaagacgagagattgcacctgaagcaagtaatgctgctggtgttacctcagctccgtcttcgaatctgtttaattcgcttacgttgattgcaacgatatctttagaatttctacatttgaagcctctcttaggaagtcttctgtataaaggcatctgaccaccttcaaaacctggtctcttagcgcctgaacgtgctttctgacctttatggcctttacctgctgttttaccatttcctgaaccatgtccacgacctcttctgaagttgtcgctctgtctggaaccttcagctggttttaagtttgataaatccatgatggcacctccttcttaatgattagatttcttctactttaaccatgtgtcttacctgacgaatcataccacgaacagattcattatcaggcatttccactgttttgtttaattttcttaaacctaaagcttctactgtttttttgtttttcggaacagcaccgattgtagatttcaccagagtgattcttaatttatctgccatttttcagtcctcctatgcaaaaatctcgtcaacggattttccacgaagtcttgctacttcttccggagtctttaactgacttaaacctgcgatggtagccagaactacgttctgtttgttacgggaacccatacattttgtacggatgtttttgatacctgcaagttcgattaccgcacgagccggaccaccagcgataacaccagtaccttccggagctttcttcagaagcatttcagcgcttccgaatttaccgatgaagtcatgagtgatacttccgttttcgtctcttgctactgtaactaattttttcatagcgtcttcttttcctttgcggattgcttccggaatttctgccgctttgcctaaaccagcgccaacgtgtccattgccgtcaccgacaactactaaagctgtgaatcggaagttacgaccacctttaacaaccttggttacgcgcttgattgatactactttttcttctaattcaagctgactagcatcaataatagtacgtttcatgtgttcatttcctcccttattagaattctaacccagcttctcttgctgcgtctgctaatgctttgatttttccctgatatataaagccacctctatcaaagacaacttctttgattcctgcttcaactgctttcttaccgattacagttcctaaatatgctgctgcatcaacgttattggttttttctaattctgcttttacttctttctgagtagtagaagcggaaaccagagtttttccaatggtatcgtcaataatctgagcatacatatgattattgctgcggaaaactgctaaacgcggagttgtagctgtaccgctcagatgattacgtaatcttctatgcttttttgcgcgaactttcgctcttgatactttactaaccatttttgcactctccttaattatttcttaccagttttaccaactttacgtctgataacttcatcagcatatttaatacctttacctttgtaaggttccggtcttctcttatctctgatttcagcagcgtactggccaactttttctttatcaatacctttaacaacgatcttgtttccatcaactgtagattcaagaccttctgggtcttccatttctaccggatgagaatatcctaaagaaagaacaagtttctttccctgtttctgtgctctgtaacctacaccgttaacttccagagctttttcatatccctggcttacaccgattaccatattctgaatcagtgttcttgttaatccgtgtaaggatttcattttctttaaatcgtttggtcttgtaacaactacctgaccatcttctaatttgattgacatttctgttggtaacgctttttcaagtgttccttttggaccttttacagtcactacattgttctcagcaattttaacttctacgcctgccggaactgctactggatgtcttccgatacgtgacattcttaatttcctccttacttaaattttcggaaaggcctattatggttcctctctgttttcagtacttcttcgtctgctgtacttagcttagattaccaaacaaatgctaatacttcgccgcctacatgcagttttcttgcttctttgtctgtaataacgccctggtttgtagacagaatagcaatacccagtccacccagaactctaggaatttcctggcttcctgcatatacacgaagacctggtttagaaattctcttaagacctgtgataattttttcgttcttgtctgcaccgtatttcagtgtgatatggattgttttgaatactccatcttcaagaacttcgtattttgtaatatatccttcttttaaaaggatttctgcgatagcaagtttcattttagatgccggaacatctactgtgtcatgttttgcagtgtttgcattacgaattctagtaagcatatctgcgattggatcgctcattgtcatgatagtttcctcctataatttagacttttcatgtgaaattaataatttatattgtaacgacccggcactaagtgaagtctgccgtaaggcgaagacttctcttaagtggcttatggtcacttacttacattttcggcttaccaggaagcttttttaactcccgggatctgacctttgtatgctaattcacggaaacaaattctgcagattccgtattttcttaaataagcatgtggacgtccacagattctgcaacgattgtattctcttgtagagaatttctgtttacgctgctgttttactttcattgctgttttagccatgaattttccctcctataattattttgcgaatggcatgttaaataatgtcaataattcacgggcttcttcgtctgtctttgcagttgtaacgaaaataatatccatacctcttactttatcgactttatcatattccacttccgggaaaattaactgctctttgattccgagtgcgtagttacctcttccatcgaatgcgttaggattaacgccgcggaagtcacgtactcgtggcagtgctaagttaataaggcggtctgcaaattcatacatcttttcgcctcttaaggttactttacaaccaatcggcataccttcacgaattttgaagtttgcgattgaatttttagcctttgttgtaacagctttctgacctgtgattaattccatatcagctacagctgcgtctaacagtttagcgttatctttggcttcacctacacccatgttaacaacgattttgtcgagtttcggcacttccatgatattcttataaccaaactttttgatcatagcatctacgatctcatttttgtatgtttctttcagtctgctcactttaaatggcctcctctcttattaatcgattactttgcctgtagttttggcgaaacgtacttttttgtcaccttccattttgaagccaacacgagttgctttgccttcatgcataaccattacgttagatgcatcaagccatgcttctttctctacaataccgccctgctgatttgccatggatggttttgtgtgttttgtgaccatatttacgccttctaccagaacagcaccttttttcggattaacagagattacttttccttctttgtctttatctttaccagcgataactttaacagtatcaccttttttaattttaaatgttgacatcaggtacctcctataatacttccggagctaaggaaacaattttcataaactgtttatcacgaagctctctagctactggtccaaaaatacgagttccttttggtgttttatcatctttgatgattacagcagcgttttcatcgaacttgatgtaagaaccgtctttacgacgaactccttttacagtacgaactacaacagctttaactacatcaccttttttaacaacgccacctggtgttgcatctttaacagtagcaacgattacatcaccgatgttcgcatatcttcttgtagaaccacccataacacggatgcagaggatttcttttgcacctgtattgtcagcgactctaagtctactttcctgttgaatcatgcttagattcctccttacgaattatttagctctttctactacttcaacaagtctccatctcttatctttagagagcggtcttgtttccataacttttacagtatcaccgatatgacatgtgttttcttcatcatgtgctttcagtttatatgttctcttcacgatttttttgtaaagaggatgttttacatggtcttcgatagctacaacgatagttttatccatcttatcgcttactactttaccaacacgtgtttttctaagatttctttccacgattatgcctccttaattattcgctgtgtttgccttctgagcaatcagtgtctgaattctggcaatatttctgcgaacctctttgattctgcttgtattgtctaattgattggttgcattctgaaatctcaaattaaagagttcctttttagcagctactaattcttcctgtaattctgcagctgattttgtctttaaatcttctacataatttttaattttcactgttatcaccgccttctaagtctgcacgagaaacgattttacatttacatggtaacttgtgcatagcaagacgcaatgcttcgcgagctgtttcttccggaacgcctgcgatttcgaacattactctgcctggctttacaactgctacccagtattctaaggcacctttaccggaacccatacgtgtttctgctggttttgctgttacaggtttatctgggaaaattttaatccaaactttaccaccacgtttgatataacgtgtcatagcaacacgggctgcttcgatctggttggaacgaatccagcatggttctgtagaaaccaaaccgaattcaccgtaattgattttatttcctctagttgcttttcctctcatggtaccgcggaattgtttacgacgttttactctttttggcattaacataattatttatcgctcccttccttagttcctttagttggaagtacttcgccattgtagatccatgctttaacaccaactttaccataagttgtgtcagcttcggcgaaaccgtaatcgatatctgctcttaatgtctgaagcgggatgtttccttcgctgtagaactctgtacgagccatatcagcaccaccaagacgtccggatacggatgttttgataccttttgctcctgctttcattgttctggacattgtagatttcattgcacgacggaaagaaatacgattctctaactgaagtgcgatgttttcagctactaactgagcatctttatctggtctttttacttctttaatgtctacaattaattttttatctgtgtatttctgtaattcagctttcactttttcgatttctgaaccgcctttaccgattacaacacccggtttagcagtatagataatcactttaactctgtcagatgctctttcgatttcgattttagaaacacctgcgctgtataatttctttttcaggaaagttctgatgttgtagtcttcaactaagttatcagcgaaatctccttcagcgtaccatttggaatcccaatctttgataacgccgactctcagtccatgtgggttaactttctgtcccatgatagtcctccttatctctcatccaacacaacggtaatatggcagtttctcttttcgattctgtatgctctaccctgtgctcttggtttgattctcttcatggtcggtgctttgttagcgtagcactctgcaacataaaggttctctgggttcattccattattgttttcagcattagcaacagctgattccagtaattttttgattacgctggaagcgtatcttgggttgtatgttaagataccaagtgcagtctgaacatcttttccacggattacatccagtacatagcaagctttctgtacggacattctagcgtaggataattttgcagacggtcttgtatctttattagcatttcttgctcttttgatctgacttctatgtcctttagccatgataaaagcctccttctaaaatattagcgaacacctgattttttctcgtctttgccgtgtcctctgtatgttctggttgcaacaaactctccgagtttatgtccaaccatatcttctgtaacatataccggcacatgttttcttccgtcatggacagcaattgtgtgtccaacgaatgaagggaagattgtagaacgacgtgaccaggtcttaataactgttttatctccagcagcattcatagcatctacttttttcagtaagctttcatctgcgaaaggtcctttttttaatgaacgagccattagtcttacctccttattttgctaatgttttaccatctcttcttcttacaatatacttgttagactgtttgtttttctttcttgtcttcaagccaagagccggtttaccccatggagtacatggacctggacggccgataccggtcttaccttcaccaccaccatgtggatggtcattcgggttcattacagaaccacgaactgtaggtctgatacccatgtgacgtttacgtcctgctttaccaatgttgataaggctgtgctcgccatttcctactacaccaatagtagcacggcagttaatcggaaccattctcatttcgcctgatggcagacgaagtgtagcgtatttaccttctttagccattaactgtgcaccgttaccagcggaacgaactaactgtccaccttttccggcgtacatttcaatattgtgaaccattgtaccaactgggatttcagaaagcggcaggcagttaccaacacggatttcagcgtttgctccgttcataactttcataccaactttaagtccttctggtgcaaggatatatgctttttcaccgtcagcgtagcagattaatgcgatgtttgctgttctgttcggatcgtattcgattgttttaactgttgccggaacatcatctttctttctcttgaaatcgatgattctgtattttcttctgcttccgccaccgcggtgtcttactgtgattttaccctgattattacgtccagcgtttttatttaaggacactaccagagacttctcaggtgttgatgttgtgatttctgtgaaatcagaacctgtcatatgtcttctggaaggtgtatatgggttataagatttaattcccattactgtctctcctttcattgtaacgccgtaagcgttgtgtaccaacgcatcctggcgtttgttgcctgcagttaaatattggattactttttcttaactgcacttttcatattttcagtcaaactcttaatcttataaaccttcaaagatttcaatatctttgctgtcttctgtaagagttacaatagcttttttagttttagctgttttaccaaatgtcataccacgtctttttgttttaccatcaagattcatagtatttacatttttaacttttgttccttcgaacattttttctacagcttctttaatcatggatttgtttgcttctgtatgaacaaggaaagtatatttcttttcgcccatagcagccatgctcttttctgtaacgattggtttcagaattacatcataatactgtacgtttgccattatgcgtatacctcctcaattgaagctacagcagattttgtcaggattaaagtgttgtatttcaggatatcaaatacgttgattgtatttgtgtatgctgttacaacatccggaatatttcttgtagataaaactacgtttttgttctcttcgttaagaactactaatgctttagaaacattcaggttatttaatactgtctgcattgcttttgtttttgcttcgtctaatgttaaatcttcaagaacgattaatttgttttcctgtactctgcttgttaaagcggatttcagagccagtcttctttcttttttgttcattttaatgctgtaatctctcggtactggagcgaatacaacaccaccgcctgtccactgcggagatcttgttgaaccctgtcttgcatgacctgttcctttctgtctccacggttttcttccaccgccactaacttcagagcgtgttttagctttctgagttccctgacgattatttgcaagctgacgaacaacagctaagtgcactaaatggtcgttgatttcaacgccaaacactgcatcgtttaattccattgttccaacttctttgccttccatattataaacagatacgtttgccatctgtgtgttcctcctttccaacgaaaactttatttaacagtcttaactgtttctttgattgttactaaggatttcttaggtcccggtacagagccttttacaagaatcagattgttttctgcatctacgcttacaacttcaagattctgaactgttactttaacatgtcccatctgtcctggcatttttttgcctttgaatactttacttgggtcagatgcagcaccgttagaacctgcatgacgatggtatttagaaccgtgagccataggtcctctggactgtccatgtcttttgattgcgccctggaaacctttacctttgctgattgcagttgcgtcaactttgtctcctgctgcaaaaacatcgcatttgatttcctgtccgagtgccatttcttcagcaccttccagtttgaattctcttacgaatcttttgtaggaaacaccagctttatcaaagtgtcctttaaccggtttgttaacaagtttttctctcttgtcagcgaaaccaacctgtactgcactgtaaccatcattgtcctgtgttttaacctgtgttactacacatggaccagcctgcaatacagttactggagttaaaactccgtcttcgttgaagatttgagtcattccgactttagtagctaaaattgctttcttcattgtttacctcctgtgattctacagcggattacactgtgttgtgcaatcatcctagacagaaagttaatatatttatatcaaccttgtaaggataatttctcattaaaaattatttctgtttcatcttgatatcgatggaaacacctgccggcatctctaaacgagacagggcatcaactgttttctgtgttggtgtgatgatatcaatcagtcttttatgagttctctgctcaaactgttctctggaatctttgtatttgtgtaccgcacgtaagattgttactacttcttttttagtaggaagcggaaccggtccactcacagttgctccattctttttaacagtttcgataattttgcttgcagacgcatctactaactgatggtcataagcttttaaaacgattctcattacttgacttgccataaaaaaagtctcctccttttcgcactttataagtagtacgacaagcggcgactgtacacattcccgtgtgtgtcatctcatttttacacacactcccacatacccgtggtaagtcttcaagattttgtacagtgacttgtcgtcagtttcctaacatgacattcgctccacggaaaacctgccttttcggcagcaacctcgcgcttcatagctatcaatgtcacagcaagaatgagtatacacgattcttcaaaataatgcaagagttttttttaatttttttatttttttttgaacacaagaaaaggttcctatgacaaagtgtttctacgcaacaaaaaaagagagtcgaaactctctttcttcgctcctatgcttcttatatacagttctatatatatagaaacattttagaataaattcgtataatccaaaagcgtcaccttattatctgaatcctcaatcacttccggatggtctccatgcgcctgtgcatttcttaagaggtcttctaccgatggactcggaagaacttcttctactacctcttctgcttttggttcttcttctgattctgaagtttcttcaccatgaacagcttctgattcttcagagttcatcttaacaatccccgcattcagtgcttcttcaatttttgcttcaagcccaatggtatcttcattttcttctggttttatttcttctgtctttggttcctctgtaggaaccaaaacttcaccggcagactcttcttgtgttccctctacctgctctgccactgtttctttttccgctgtttcttccacagcaggctcttctactgtttctcctgttcttaacagttctgactttaacaattctggttttaacacctgtgtcttttcgccggcaatttctttttcatctgccggcactactgttccctctttactcatctccactgcatcctgtaaatatgaattttcatctgactttggattctgctcgaactctgtctggatgttctctgttttttgaacagattcatactctttggcagtttccggctgtgcctcttcctgcttctcatttgtcggctcttcggaacgtttcgattcaagcggaatcactttttcttctgtgttcttttcttcactttctgattttgtttcttccatatcttttttatcttttctccacaattcggcaagaataaataaaataattaaaaagacaattccaagaccaatcaaaatcaatccttctttactttgaactgcaatcgctgcataagcaataagtggaacaacaaaagacagcttcataacatctccgctaagctctacactgcgttcttctgtctttttatcataagcatctttcaccagatacgtgtcattttctgcatccgatacatctgaaatctcataaacataagcctgattattttttgtataaacaatcttctgtcctttcttcagatttaccgcatccgtctgcttaccataagcaacagaaccgaccggaagatttgtctccgccgtactgttatcattcataaccgtctttactcctacaagaggaggtactaacaaagccgctgctataaggatggtacagatgataaccaggtccacaataagttttaaaaattttgacatctctgtttcctcatttcgcaattctttcatttcttatcttaacattttctgacaaagatgtacacaaaaactttaattgatattcaaactgatattctaatcagatatccgaaatgaatattctacagattcgtcagaaatgcctgatatcccttatatgcttcataaatatccactttacttgcaatttcccacggagcatgcatatttaatacggcaactccactgtcaattacatccatatcgtatgctgcaagaatataggcgatagttccgccgcctccaacatctacttttccaagttctgcggtctggaaagaaacattttgctcgtccatcacacgacgcaatcttgcaatgtattccggatttgcatcattagaaccgctctttcctcttgagccggtatatttattaaaggttaatccgtgacctaaaaatgcacagttattcttttccatcacttccggataatttgggtcaaatccggcgctgacatcagaagaaagcatgcaggaattttttaatgctctgcgcacaagcagttcactgtaagttccacacgcattcatcacttccgccaccgtattttcaaagaatctggaatgcataccggttgctcctacacttccaatttcctctttatctaccaacaaacatacagaagtatattctgcctctgtaactgcctcaatcgctttataagacggataagcacatactctgtcatcctgcccataagccataatcatacttctgtctaatccaaagtctcttgcttctccggccggaacaacttctaattcagcggatacaaaatctttttcttcaattccatatttttcttttaatatagaaagaatattttcttttacgccttcggtctcctctccctctaacggaatacttccaaccagtacgttcaaattttctccctcaataacttctgtcgcttttttctgcatctgttttgcagaaagatgaatcaataaatccgaaattccgacaacagggtcatctttggattctccgattaccacatttacttttgttccatcttctttcaccactacaccatgaagtgccattggaagtgtcacccactgatattttttcacaccgccataatagtgtgtatcaagcagtgcctgttctgcttcttcgtacaacggattctgctttaaatccaaacgtggagaatcgatatgtgctccaaggatacgcattccttcctgaattggtttttctccaattacaaaaagagccagtgcctttcccatattgttggcgtacaccttatcccctttttttaaagtttctcctttttcaataacagtatcaagatttttaaaaccggctttttttgcctgttttataatttcatctgtacattctctttctgttttgcataaagacataaattctttatagccctcgcagaaatcaaagactggtttcttatctgcatattttttccaagcattttctgttttcattctcttcacctcaatcattttattcttcctacagcttactacaccttcatttgaattgcaacctgccaagattgactttttacccagtttctatcataataagttcaagtcgaacgcatgtgagacttggcgcgtgatttttgtggaacatttatcttaaccagagaataagtttccgacggagataccgttattttgtacgaaaggattttgccttatgaagatgaaaataaagaccatagaagacctctctttaaatgcctggccttctcataaaattttaatttacgacggatggattatccgcttttcctgtttttatacccaccgcacaaactgtgtggagcaaatcggctcttcacagattgcgctctctgataagattgcctattgcgaagaagtctatgaaaaatggaatacacctgctattttcaaaattaatcctttaatggacagttcctttgaccagaaactaatggaacgaggctatcatattgcacataccacggaagtcatgacaatgagcttggaatcttatgaaccaaaagaaccacttgccgaggtttcccttactccacatattacctctgactggttaaatgctctttttgaaatgaacggtacaaccaatccgattcacaaaaaaattgttccttccatgtatcatgcgatcccaggagataccatttttgccactgtctatgacggtgataacgtcattggaacaggtcttggaattttagaccgtgattatgtcggcatctacgcgattcatgtcgctcccggttaccgcagaagaaaaatcggtcagtctatctgccgtgcacttcttaaaagtgcgagagaacaaggcgcctgttatgcctaccttcaggttgtaaaaggcaattttggtgctcgtactttatatgaatcacttggttttgaatatctttacacttactggttccgccagcagttttaaattttaaaaaataaaaaaggaactccgcagagctccttttttattttttgctatttattcaatctttttatctgtagaacaggcttccaagctgtaaatctctcttgaaatctctgattcttgtttctccatcgatataaacagcttcaattcccattgctgctgcccagtctcccatctgttctgctgtgatatcataagagaatgcggtatgatgtgctccacctgctaaaatccatgcttctgcacctgtagctaaatctggttttggtgtccagaatgcggttgcaaccggaagtttcggcattggtttttctgttttcttgcagtctacttcgttgataatcagacggaaacgatttccaaggtcaattaaagaagttgcaattgccgaacctgtcttagatgtaaatactaaacgtgcagggtcttctctgtcacccatagttaacggatttactttgatgctgattggaccatcagaaatagtcgggcaaacctctaacatgtgcgcttccaagataccttcttttcccggtactaaattataagtataatcttccataaaggaagttccttttgcatctttcattccggcagtcatgattttcatcaggcgaaccatagcagctgttttccagtcaccttctccaccgaatccataacctttttccatcaatctctgaatagcaagacccggaagttgttttaaggagcctaaatctccaaaatgagtaacgattgcctgatagtttttctcctctaagaaacgttcaaacccgatttcaatctgagcctgcgcagctacatgtttcttaaattcttccgggtctcttccctctaagagaatgtcgtatttgctgtagtattcttctactaaagcatctgtatcagctttggatactgctgaaactgcttctgcaatctcattaaccggatatgcatcaatttcccagccaaatttaatctgagcttctactttatcgccttctgttacagctacgtttctcatgttatctgcgattctcataacacggatatggctgctttccatgataccaattgctgtacgcatccaggaagcaattctttcctgaacttttttgtcgctccaatgtccaacgataacttttctttcaattcccatacggcttacgatatgaccatattctctgtctccgtgagcagactgattttcgttcatgaagtccatatcgatggtatcataaggaatttcctgattaaactgtgtatgcagatgaagcagcggctttctgtattcctgaagacctaaaatccaggattttgccggtgagaaggtatgcatccatgtgataacacctgcacattcttcatcttcatttgcttcattgaaagttcttctgattacttcgtttgtaattaaagttggttttaatacaacttcataaggaagtactcctgatttatttaattcttctacgataattctggaatgttctgcaacttttctcaagcactcatctccgtataaatcctgtgagcctgttgcaaaccaaaacttataattttttgatgctttcattttaaaaaaatctcctttcaccgttacgattttctctcatggtttttctaattcccatgatacagcttgtatggtcatctttacaagttgtatcacaagaaaacagacaagtttttcttgtgcacatacaagttctatttatacaaaaagaagaaagagtagacaaacaaaactgtttatccactctttcttcttttctttttcgttttcttcctgtatttcttttccgtcaaatattactctttaaaacaaaagcaattacttccgatttgataaataagcctcgatactcttcatcgcttcttcttcatcttcaccttctacagatactgttacactttctccagcatctaatccaagactcatcattcccataatactcttggcatttactttctttgcttcactctccagataaatattgctggaatactgacttgccacctgaactaacatagcgattggtctagcctctaacccatttgaaatgccgattgtaattggttttctgatcatacttgttcctccttacttcccctaagttcttctgctatcctgccaattttacgcaatctgtgattgactcctgactttcctactcttggatttaaccgttctcctaattcttttagggaagcatcctgatatttcaatcgaagttccgcaactgcttttagattgtccggcagtgtctgaagtcctaccgtattctggatatacctgatatcctgtgtctgctttaccgatgccgacaccgtcttgttaatatttgccgcttcgcagtttacctttcggtttacactgtttcgcatttccttaaggattctgacattttccagattcataagtgatacgcctgctcccatgattccaagaagctctactatctgtgctccctcttttacataaaccacttcgtgcctttttcgactcactgtcttagcctctacttcaaagctgtgaagcgtttcctgaagctgttctgcctttatcgaacttgtacagacaatttcaaagtggtaaaacttttccggatcactgattgatcctgcacataaaaacgcacctcttaaaaaagctcttttacaacaatttttctggattatcaacggatttaccagaccattaaatgtaatcggcattctgtcctgtgacagatacttcatagcctgcaaaatccgaatcgcctcatcctcacctggaatgtccactacatacttattatttttcctgtataagacatcccctattgaaaacactttacttattctaaatgttttttccaataaagtaaagtactttcttgcaacactttcgttttctgctaaaaaatgtaatgacagtctcttttctgctccatattttatctccccgccaaatgcaaacatcgccgcaagttctgctatctggcaatgccttgcagggctgataattccctccagttcttcttttacactcgccgaaaacgtcatctctttgcatccttttcaatgtctctatgctcaatccgaacaccatattccccatttttattcagtctgttatataattcattggcaagagttacacttctatgttttcctcctgtacatccaattccaatcaccagctgactttttccctcggaaatataatttggaattaaaaaccgcatcatatcttccagcttgtctgaaaatatgtgtgctaattcagacctcatcacataatcccgaaccgacgggttatttccggtctgaggacgaagttcctctatgtagtacggattcggaaggaaacgaacatcgaatactaaatctgcatcttccggaattccgtatttaaatccaaacgacaagaccgtaataatcatattttggaatgattgattatctacaaaaatcttttccagttccgcctttaattcccttgtcaaaagctggcttgtatccaaaatataatctgccgattttcttaaaaattttaaatattctctctcttttcgaattccctcatctactcttcccttaccggacagtggatgagagcgccgtgtttctttatatctttttaccagagttttatcatctgcatctaaaaataaaatttcaggttcaaatcccggaactctaaggcgttccagtgcctgctccagttccccaaatgccatcccgctgcggatatccactccaagtgccactttattaatgtctcctgaacctccgtcacgcaccagttgtgcaaatttatccaaaagcggaaccggaagattatccacacagaaatattccatatcttcaagcatctttaatgctgtactttttccggccccggacattcccgttacaattacaaaacgcatctttaaaactctcccaaaaattttatctcagtctccagtaaaataccgaactcatcctgtacttttttctgcactgctttcaccagatttaaaacatcctcagctgttgctccgcctgcatttactacaaaaccacagtgtttttcagaaacctgtgcaccaccgacctgaaaccctctcaagccggcatccataatcagttttcctgcaaaatgtccctccggacgtttgaaagtgcttcctgcgctcggtctgtccaacggctgtttgctgactcttttttcttttaaatcatccataactgccttaattgaatccgcactgcctttctttaactcaataactgcctctaatacaatataatttttctcttttacaatactgtggcggtatcccagctctaattcttcatttttgagtgttcttacatttccctctgtatcaaggacagttgcctctaccagcacatctttcagctctccgccataagcacctgcattcatgacaactgctccgccaagcgttcccggaattcctgctgcaaattcaaatccttccagagactgttcaagcgcacaggatgcaattttagaaagctgtgcccccgcctgtgcacgaatttttgtttcatcttctaccgatactttactcatatttttccaaatctgaatgactgccccgcggtaacctttatcactgacaaggagattgcttccatttcccagaataaaatacggtgtccctgtctccttacagacatgtattactgcttttaattcttccgctgtctgcggacataaaaaataatctgccggtcctccgattcgaaacgtagtatgtttttccatcggttcttctaacttaacattctcaattccaatacaatcaattaatttattttcaatttctttcttcacttttttacctcttaacttatattatgatgtactacagaaaagttccgaacgtacatgactcattctgtcaggtctgaaatcacctgcgctgctatcataaaccccgcaattccggaagaaaaagaaatactgttcacctgtgtacctacactggtctggtcttctttcaaaacagaacgtttctttttggaaaactcctgtgtagaataaaaaacttttatattttttgctttttgaatctttaattcctggcgaatttttctcataaacggaagattcaccgtcttagaaaaatctgctatgcgaaaacaggaaggattccacgcatttccaattcccatacaggtaattatcggcgtatgaaactttctcatctgctttaacaacaacaattttgccggaacatgatccattgcatctacaacataatcataagaggaaaaatcaaataaatcaatcgtgtcctctcctaaaaaagtttcataagtatggacaatcgcattctcattaatatccatgatgcgcactttttccacctgcacttttttctttcctattgtagaacgcagtgccacaatctgacgattcagtttcttcgctgacacctcaccataatctaccaatattaacgtccccactcctgctcttgccagcgcttcaactgcataagaacccactgttccaataccaaataccgccaccttaagctgatccggactctttcttttttctgttcctgataatccttccgtacgggagaatacgtggagcatacgtttccttcctcctaatgtttctatgaaatataaggatgccaaaatttccaagctcaattccaacatcattacgtttcattatactattaattttggaagttgtatagaactactttttcatctttggtttaaaaatcaggctcgcaagatagccaaaaatcagcgctgccgaaatccctacggcacttgattcaaaaccaccctgaaaaatgccaagcagtccctgctcatctaccgcctttttgattcctttccacaaagtatttccaaatccaagcagaggaacactcgcccctgctcctgcaaaatcaatcaatttctcataaattccaagtgcaccaagcaccgttccggtacagaccaacagcaccataactcttccgggcagaagtttcgtccggtcaagcagaatctgcaccagtgcacaaatcagtccgcccacccagaatgcattcagataatccataagttcgccctccacattgcgtattgcacatcttttttgcattgccaaatctattttaacaatgttcgattacaactgcctgggcaatcccaggcacactttttccctcattataacttactttagataacagtgctccagtcggtacaaacagcacccgcttccattcacctttttcaattttgggcagaatatacgaagcaaatgtcgtggcagaacatccgcatccacttcctcctgcatgggtgtcctgtgtttctttatcataaatttcgattccacagtccatcagctttgccgtaacatcatatcccttttctttcaataaatcaatcaaaatttcttttcccacttctcccaaatcaccggtaataatgcggtcgtagtcctccggttttcgtccaaaatcctccagattctgataaatggtatcgctcgcagccggtgccatacaggctcccatattcaaagaatcctttaagccgtaatctatgattttccctgttgtaattccggtaattcttgcttttccgccttttcggccaagcacacaggctccgcttcctgtcacagtccaggtagctgaaaacggtctttgatttccatatccaagtggaaatcgaaattctttttctgcacttccaaaatgacttgaagttactgccacaacataatctccatatcctcccgccaccgccatagaagcaagcgacagtgcttctcccattgtcgcacaagctccatacaatccataaaccggaatttcaaatccaataatcccaaaggaagaggcaatcgtctgtgccagcaggtctccggcataaatcatacggatttcttccttggagagtcccactttttttatcgccatcgatactgcttctttttgcaggatactttcggcttcctcccacgactggcatccaaacagcccgtcctcttctcctattttgtcaaaatattttccaagcggcccatctccctctttttttccaaccatagaggctccacttaaaatatgcactgcattatgaaataaaatactctgttttcctatcatctgttcccgttccatttttatccagacctccttatacgattccacattgtctaagcgtataataaatcagccccatcagtgctgaagtcaaaattccatacagaatcaccggccctgcaatgataaaaattttacacccaatgccgaatacctgtccttctttttgatattcaattgccggtgccgctactgaattcgcaaaccctgtaatcggtactaacgtgcctgctcctccccattttgcaagtcttggataaatattaaatcctgtaagaatgacactaaaaagaaccaggaggagcgaagtccagcttccactggtctgcgcatcaagcccctggctcttacaaatattcataattccctgtcctatcgtacagataatcccacctgataaaaaagcacgcgccatatttttcggcaaactgtgaacaggtgtcattttttttacgtactttccgtattcttcttgttgttttattttttcaattgcttctgctgtggtttgagtgttcttagccataccagtcaccatcctcttctatattcttgaaatttttctacagctcatttcaaaaatatatctttttactttaggattagtatggcttttcaaaggcaaaattattacttctccgcttctttttcttctccgtacaaccgttttgccctcttcaaacaatgataccggtctatcgacatcacaagtcccatttcagccataataataacgatagaagtacctccatagctaaaaaatgggagcggaatacctgtatttggaaataaattaatatttactgcaatgttaataatactctgaactccaatgtggaaaaagactcccatcgccagtacagaaccgtagacattttcagaattctttgccacctgataaatcaggtacaacagataaatcaaaagtccgataataactaatgcgcccaccagtccaagttcctcacagataattgaaaaaatcatatctgtatgagcttccggaataaatcccggcttcttttgtaccgaattaccaaatccctttccaaaaatcccaccggaaccaatcgcatacaaagattgaagcgtctgatacgattttgtcgaagcatatttctgtggtgcaagccatgcagcaattctcgccttacggaacgaatatgtatccgcattaatcaatgtttcacttggcagattaaagtaaatcgaaagcaccattgcaagactgacggctattacacagacaagtgcaactatttttaatttcggtgatttaatgcagaccaccgtgattaggtaagtaatcccaagtacaacaattgcagaactcaaatccctcgacaactgccacaacatcaccgccggaactgccccgactccccacaataaaaccacaaaataagaattattttttataattgtcggtctaatccagtcagctgcctgaataacctttgccgaccgcttctcaaaaatcttgtgtcttggcttcatataaacataccgtctttgaatcagacaggccaatgccaggatcacaaatacttttaccggctcagccacctgaaaggaaatcggtcctaactgaaaccagcgcttcgcaccgtttatctcttctccttttgcaaacacccataaaatcaatccaattccaacaagataccccactgtcgtaaaatgccagaatcctgtataattcaatttcggcaaaattaccatgcagactaatccaagcaaaataaataccatctgccgtttaaaatagtagaaagaatcataattatacttttctgaattcgcacaggtcgtactcgacgcagaataaatcataattgcaccaaaaaagcacaaaataagcgtcactgcccaaatttgaaactctcttctctttaccattgaaagatacttttcttttatctgcttatttcgttttttattttcttttttccggtttttctctcttattttatctctttggctttgattttgtttctttgagcccttttttttctcactttttacagccatcttttctctccccatgaatcgctaactttaatagattaacacaccggcagtttatttgtctatgtttatccgtaaaatcggtcaattcgttttatgagaaagtctggctttttcattttgattttgctcgttataaccctcaaagccctcttcaatttcttttaaaatctctgcataacgaagcagttctctttgaatttcttctttattatcacgctcctgtttataacagattcgatgctccatgcttgcccagaaatccatgccaatggtgcgaatctgcacttccaccggataatattctgtactttccatcgaatatacctgaatccccagaatcatgtgaaaactgcggtatccatttggttttggatttgtaatatagtctttttctttgactaaaatcaaatcactctgttttcttaactgttctgcaaggagttcgacatccttttcaaagtagcagataacacggattccggcaatgtcctgcaaatgctcttttgcattcataaaactcccctgcaaatccatgcgttttaatttttcttcgatacttgctttttgtttaatacgaaactgtatattatgaatcggatgtgatttattgccatacatggaatgattgagtacatcaagtctggcttttaaaagattcaatgcatcctgatacggcacaatcaagtcgtagtattgttcatttgtcataaaactttctttcctccggtcttaaaaacttacagcagtccgcccattctgctgccatgggttattataccatattcaatgccggtggaaaataaatcttccatgaaatttctatgaaactcttatagattttttatcctgtaaaatgcttctcctgatttccccagactcactatccttttcttaatctttaacaaaaaaactgaaccagacttccaagtacctttccaactgcaagcgataaaataaccagtcctgcacctttcgtaagaccgactcttcttgccataattgcaaatacattcacgacttctccaagcgcaatcacccagcttcccagaaaaatcccaaatccgattccaacaagagctacgcaccagatacccagattgatatgaatccgataaagtaaaaacagatttcccagaaaactgccaagcatcaggctgttttcataaaacagtaaatgatttccggtgtgtgtcactccggcatatctcggaatcattccaagtccgataataaatgccgccagagctgttgctacaaccataccgccacataatcccacaattccggccaaaagctctcttaacatcttattttcgttcctttcttttttcctgctcaatcagtgtcttattgacatcatcctcataaacccgcatttctacttccattggagtcgggtcttccgtaatctttctgccaccaaaatgattaaagaaaaagacaacaccgagtccgattccaattgaatacgatagttccaaaattgtttttccatttgaaactcttccggtgatctgctcatatactttcataaataaacctgccgtatcaacatccgtattgaaggtcataatcgaaaatgcccctccaaaaaatgtcacaagcgatacaaaaattgtttttaaccaggaatagaattgatgggcgtgtttctgtgtttcataagtcagaataaaatttgcctctccgatatgcgtcacatctacgctctcttcatttctttgaattaaatccacgatttccagtgcagatattacataccgccctggtttttcatttggaatcgtaaataatttgcgggctttatttcggtttaatacttttccattactgcatgacaaacttgccacatcctgaacgtaaacttcgggactgtgtacttctacatttttttcggtctgtatatataaaatatcactcatgttttctgctgctccttgccttataagatgcagaatttagtatttaacaaacgtctgaaaattatacctgaattactctggattactcctaatcaatccgttcccttaaaacttttaaaatctttttctccattctggaaacctgaacctgcgaaattccaagttctcctgcaatctgcatctgtgttttttcctgaaaaaaccgcagataaatcaattcccgctcttttgcctccagacttcccaaaagctgttcgagaagcattttatttaaaagactctcctgtccgttttccggttcttcgattttatcttccagtacaattccacttccatccccctgataaatcatcttctgcagggattcaatctgtgcacctgcctccattgccatcacgagttcttctctcgtcaccgcaattttctctgcaatctcctcaagccctggttctcttcctctttcggcaaatagtgcctcatgtacccgataagcctttgcattaatctcttttaaagaacggctgacctttatcattccctgatcccttaagtaacgcttgatttctccggttatcatcggaactgcataggtagaaaatttcacatcaaacgaacagtcaaatttatcaatggcttttaatagcccaatcgttccgatttgaaataaatcctccatctccactccacgatttaaaaatcgttttacgatactatgcaccagacccgtatttttctctaccagcgtatctcttgcttccttatccccttggtgtgcacgcccgataagggcaaggacctcatccatagcgcctccttattcttcaaagctttccctgcttatgccaattttctttctcatacgcacggttgttccttttcccacctcggattcaaccaaaagctcgtccataaatgcttccataaatgcaaatcccataccggaacgttcctggtccggtcttgtcgtaaacattggctccattgcctgttttatatcttcaattccctttccataatcaattatcgtaacaaacaactctcttttacctgtcttacattcaatcctgattttctcctgcttcttgttatcataagcatgaataatgcagtttgtaatcgcttctgatacggcggttttaatatctgcgacttcttctaatgtcggatttaactgcgttgcaaatgctgcaacggtcactcttgccagactttcattacaagaacggctgacaatttctaatgtcatttcattcgtatactccatttttatgctcccccttatctttttttctgatgccagactgtttcctgactgatttcaatatatttataaattccggaaatccgcataatccgatatacacggtcattcacatgaattgccgtcactcttcccccactataacgcacaatccgataccgtcccatcaacattccaattcccgaactgtccataaatgtcgtctttgaaaaatcaaataccagttgggaaatctcccctttttccagctcttcatccactaccttggtaatctgctgtgcaaaatgatggtccagctcttccggcacataaaccatcagacaattttcccttcgtttgattacatcactcatactgattaccccttactctattctttcaatcttttgtaaaaaaaggatgaatactcatcgtatccatcctttttctcaaggtttctcttttgatttttctattcttctgaatcttcttcactataatcagaataactgttatcctcttcatccgagttgctgtaatcttcatcattattatcattagaggtatcttcttcatcattattatcataattcgaatcatcctcttctgaattatcttcttcatcataatttgtatcgtccgaattatccgaggtatctgcctgactttgcgtctgactggattgtgaagaaccagaagaagaacttccccctgtcaatgcatctaaataatcctgcgcatcggatgcattctgtgttccagggaaggtatcaataatcttctgataccaggtctttgcattgtctgtatccccactcttctgataagcctgtgccagatagaacatcgaagtaaagtccggttctccgatatcaagcgcttttgtataattttcaatagcagttgcataatcaccgctctcataagcatccatcgccgtactttgatatttctgtttgacactggaaccaatgtctcccataatcgcatcgtacatactctttgcttcaacggaaagcaggtcactgtttactccttctaaggcatttgctgctgtctcataattttcatcattatatgcctgccatgcctttaaaagattttcatagctggttgttgtttcttttgcctgagaaatctggtctgtcgctgtatttacagattccgaagaattgtcaatttcttcctgcagacgagtcagttctgctgcctgtgtcgctactttatcgctgtattctactactttctgatttgctttttgattaatccgctgattctgtgccggaacaaccaaaaaccacaatgcggaagccccgaccaaaagcccgataatcagattgattaatgtattggtaacggtacgctcccgatattccattggttgaatgaccacgtcatttccggagcgataaacgactcttccttctttttcctgttttactttttctcttgccttaaatcttggctctaaatttgtaattttaccggtctgctgttctacttctcttaaaaaacgcagagtagtcgtattggtcttatcaatttttgccgctgatttcaactgctttcttgccttctcatattttccattgcgaatataaatcagtgccagtaaatgataacctttaatcagtttcggattgtccgcaagcacttttctaagctgcatctctgccatgtcgatactgcctcttttacagtattccagacattgattgtactttttgatactcatgttaatcgtatcaaggcggtttgcatttttctgcagacggttgatataatcagctgcgatattattttccggctgcatatttttactgattacccattcacttaatgccgcaaccacttcaccggtctcaaaataaaccagtccgagaagatttctcgcatgaatattgtatttatacattctaagacttctctgcaggcaggtaattgcccctgacaggtcacgaatctgtgctttttccaaacctctgttataatacaaattcgataatgcgacaatctgtttctgcaccgtcacattgcatccgcatccagggcaataggaagagctgttaagctgggtattgcatatcatacatttcatctatttactccctattttctggtgttcccttcagtttcttttaaaatttctttgagtatatccacaacatcagtcaaatcctgacgataaattgcattttctgcatcgtccacatcctgacacggctcaaatttttttaattcctcttcgtaattaatcatttgtttctcctttttaaatagtccttaatctctccaacgagatacaaagaacctacaacaaatagtaacccgtctcctttttttgcataagccagttcaaatgccttttcacaatccggttctgcatagacctgcttacaaccgttttctctaaacaattctgcaagttctgttgaagactgttttctgcttccccagatttctgttacatatacattggagaaatgaagtccattacagattttctgaatcatgtctttaaaatctttatcggaaaccgttgtaaaaagcagagtaattggataatcatcctggaaataccgaacggtttctacaaattttgcaattccatcttcattatgagctccatccacaatgacacctggcagtactgtttccattctgccctgccattttgtatgctccatcccggcttttaaggtttctttttcgattttatgaacttcttttaatactcccattgtttccaccgcaagagatgcattcatcatctgatattttgcaataaaaggaatgaacaagtctattgtaccataaattttagaatcgtaggtaaatgaaattccatccggtgtataagaagtcatcttctggcttgcctgttttacctcataatacggacaccctagttcttttgcccgatttttaatgactttttcggcctcttcctgatttccatcaaagataaccggaacacccggcttgataatgccggctttttcacctgcaatcttttcaatcgtatcgccaagatattccacatgatccagactgatagaggtaatcacgcaggcaagtggagatacaatcgaatttgtcgcatctaaacgtccgcccagcccggtttccagtaccagtaaatctacatctgcctcatcaaaaatgaccattcccattaaaaatagaaattcaaaataggttggatggtaatctcctgcctctacaagctcatctgcaagcgctttgatttttaagaaagcccgtaaaaatgcctcatctgaaaccatttcttcgttaatctgaaatcgttcattaatctttatcagatgcggtgaagtaaacaacccgcacttatagccgccttcttcaagcattgtggaaagaaacgcacagacactgccttttccatttgttcctgctacatgtataatttttcgttttttatccggacttcccagtaaatccagacactttctggtatgttctaatttatttttcgttgtaaatttcggaatttcttctatgtatgcaactgcttcttcgtaagtaaacaaaaattaatccttctttcttttgtcatttccctaaaaaatcaccgctccattcacaatgataagggtcacttaccattataatgaagcggtgacaatatgcaagcaaattatgtcggttgtaaactttttcttttactgtgtctcgacagtagtttctgacttctcggaagatgccccgttttccaccgcgtctgctttttcatctgtttttgtttctgtctgtccttctgtctgtccttctgtctgcgaacccatatctgtctctgttgtgtcttctgtggattcatctgtttgtgctttggatgtttcatgataaatctgtgtttctgtccgacttaatacctttcgggtagaactgttactgcggattgcgatatccacttcatctccatcctgtaaatcaccatctgtcagaagaagcgtcgtcggactgacatacgttacttccactaattctccattcacctcaagataagcagactgcgtgaagtttgtaccggtaatataatatctgccatccgaaattttttcaattttatctaaggttacttcttccactccaagatgcagcttttctttctgatatggattttttccgccatagacatactgttttccatataaaatatcatactgcagcatttccaaatctgcctgataattctttgtctgtcttcttgcctgatgataacggaacacatttccttcatgaattccaacacggttcatgacttctgctgccatctgataagcagcaatatttgcatctttcttttcaagctccatattatcccagattacatattctgtctggaacagataacgattctccatatcttctacggtcaatcccattgtcggaagatgatccccatacatgacaagcactacatcttcatcaagttgagataaggtatccgtcagttcttttacaaactggtccatctcataaatctgattacagtaatactcccatttattatttaacgcctctgtactcgaaccgcttactgtaatcttcggattttcaatcgtcggttcttccggataatctccatgtccctgtaccgaaatcgtataaatatagtccggatcatctgtctcatttaacgcctgcataatatattttgtcagatttcgatctctcatccagtcattcgggtttgtatcatcctgttccgacatatactcttccgaagtaaaggtatcaaatccaagatttgcaaatacactttttcttccataaaagttcgcctcattattatgaatggcatgagtccgatatcccagactctttaatacataaggtgcactttcacaagttgtttcttttaaaatactcttatatggatattcgccaggtccaaaataatgtaagctcattcctgtaatgctttcaaattctgtatttgctgtacctgcgcctacagaaggcactttataatatccggaagaatattccttcatcagttttctgaaatttggaatcgggtcttccgaaacatttaaataattaaccagtgtcggatcaaaaaaggattccagctgtaaaaagataatatttggtcttttttctcctgttttgggcagatttgattcactgtcctcaatttcattgattgctgattcagaataatctctcggacagctgattccggtattaaaaatcgtagttgccagacagtatggatatccataatcctgataagcaaatgcaatatttccaaagtaattggaaagcactcgtttatccagtgccagtctggttgttcctgcaaatgccagcactacaatcagcacaaacggaatattgacacggtaacgtaattttcctctgtatcttggcccttttacaaataaaataatcattgcaatcagcaccagtattgcaataatcattacaataacaaagaaaaacggattcaaatacttatttgcaatcttaactgcgtcggtaatcagatgtaaatccggtcctgtaaatggagtgacacggtttgccaaaagcacaccattaataattccaagtccaagccagaaaatagttaacaataccctcataaatactcttcttcttaccagatacactaacatagtggttgtaaaaataagaaatgagttatataaaaacactaacggtctttctgtcatatagctaaaagcttctgacacagaatgtctggagatggcctcgattacaaaatataagaccatcactccaaacatctgaagaggtactgacagaaagttcaaaattttgataaactgtttttttatggatttcaaatgctcaatctcctatcagccttgcttacttttcaagctgtttcagtctctcttttacctgttccatcatatttgtatatttttcaagttttgctttttcttctgcaaccttgctttccggagctttgcttacgaagcgttcattgcttaacattccttttacgcgggcaagctctttgtttaatttttcttcttccttgtgaagtctttctacttctttttcgatatctaccagttctgcgaacggcatatagataactgcctttgaagttacagcagaaacagcatcttcatcgattccggctttgtctgcctgtacaacaacttcacttgcataaccaagtgttccaaagaatacttttccattttcaaatgtctcacggattgcttcatcttcagaaacaacaaatacttttgctttcttgctcggcggtacattcattccggtacgcacattacgaatgcttctgactgcttctttgatgatttcaactgcttcttcatccgcttcaaaatcccatttggcttttctttccggccaggaagcaatcatgatagattcttcttccggacgaagagtgcagtagatttcttctgtaataaacggcatatatggatgtaataatttcagtgcatttccaagaactgtttttaaagtccaaagagctgctgcttttgtggtgtcttcttcattgtacaatctcggttttaccatttcgatataccagtcgcagaattcttcccagataaagtcatagactttctgaacagcaataccaagttcatatttatccatattttcggttacttcttctgccagtttgtttactttagaaagaatccatttatcggcacccgttaaagcatttaaatcaatttcctgcggtacttctgctttttccaggttcatcatgataaatctggaggcgttccatactttatttgcaaagttacggcttgcttctactctctcccagtagaatctcatatcatttccaggtgcatttcctgtcatcagagtcagacgaagtgcatccgcaccatatttatcgataacctcaagcgggtcaattccatttccgagggatttactcattttacgtccctgtgaatcacgtaccagaccatgaatcagtacatgatggaatggagtttttccggtctgttccagacctgagaataccattcggataacccagaagaaaatgatatcatatccggttaccagtacatcggtcggatagaaataatttaattcttctgtattgtccggccagccaagtgttgagaatggccataatgcagaagagaaccatgtatcaagggtatcttcatcctgtgtcagatgttcacagccacatttcgggcatacagacggcatttcccttgcaacaactgtttctccacagttatcacagtaataagccgggattctgtgtccccaccataactgacgggaaatacaccagtcacggatattttccagccagtgcatgtaaatcttatcaaaacgttccggaacgaaagtcaggttgccatcctgtaatgtcttgattgcagcctctcccatttctttcattcttacaaaccactgcggtttaatcattggttctacggttgtaccacaacgatcatgtgttcctacactgtgagaatgcggaacaacttttactaaaagaccaagctcttctaaatcttttaccattgcttttctggcttcgtaacgatccatgcctgcgtattttccacctaaatcattaatggttgcatcatcgttcatgatattgatttcttcgaggttatgacgttttccgacttcaaagtcattcgggtcatgtgccggtgtaatttttacacaacctgttccaaattctttatctacatattcatcagcgataaccggaatttctctgtctgtcaaaggcagttttaacatttttccgattaaatctttgtatctttcatcttccgggttaactgcaactgcagtatcgcccaacagagtttccggacgggtggttgcgatttcaacgaaacgaccttcttctccaacaatcggataattgatgtgccagaaaaatccatcctgatcctcatgttccacctcagcatcagaaatagaggtctggcagaccggacaccagttgatgattctggaacctttgtaaatatatcctttttcgtataaacggataaatacctctttgactgcttttgaacaaccttcatccattgtgaaacgttctctgtcccagtcagcagaagcacccagtttctttaactggttaataatttttccgccgtactcttctttccatgcccaggcatgttttaagaattcctcacgacctaaatcctctttattaatcccctgctcttttaatttttcgattacctttacttctgtagcgattgctgcatggtctgttcccggctgccacaatgcctcatatccctgcattctcttaaaacgaatcaggatatcctgcatagtttcatccagtgcatgccccatgtgaagctgtccggttacatttggcggcggcataacgatagtaaacggttttttatctctgtttacctctgcgtgaaaatatttattatcaagccatttctgatacagtctttcttcaagaccctttgggtcataagtttttgcaagttctttgctcatgactacctccttgtttttattggtttatttttttgcagacatttatcataaaaataaaaaagcctttacagataaaactgtaaagggcgaatgtccgcggtaccaccttgctttttaactctaagtctgttaacgcagacgacgcgtgaacacctacgcaggatggcttttctttacagtcccctcaccctttcagcattccggttccaaagctaccttccacttgttcctctgaaacgtgctttcagcattttgccgttctctctggcagatttccaaatgtactcctctttttcaacaccttttgctacgatacatcataatcataaaaaatctttttgtcaagcaaaaaaatgaaccggaagttccgattcattttacattcgctctttctttatttacgggggaagttttcttccccctgccgtttaatcagtcgcataattctataatgttcaggctccgagctttggcattccatacgaattccagatacaaaactttggcacggaagtttttcaccttactgctgttaagcaggtttcctggctcatggattaacgcttcgccgcccttctcatataattttatacaatgggtatctccggcgtcactccccatatacagtgaccggctcgctcaggccttgcacctgattcccttttcacctattctgtgcggtcagtatagatgcactcaacagttctatggaattatactagatttatagtaccattttctatcagattcgtcaagtttccttttacattttgcatgataactttttaaaatcattattcttcgctgtcattttttccagcatgccaccaaatgtcccggtgtcctttcttctaattccggttcctgctgcctgcacaaatccatcgcatacggacaacgtgtatgaaatcggcatccggatggaacatgaagcggacttggcagttcccctttcattccaaactgttccagactaagtgcccgctttggatccgcaattggaatggctttcagaagtgcctgtgtataaggatgacaaggattatcataaacctcatcgctttctccgctttccacaacctttcccagatacatcacaccgatccgatctgaaatatggcgtaccatagataaatcatgtgccacaaacagataagtcagtcccagttctttctgcaaatcttctaacacattgacaacctgtgcctgaatggatacatctaaagcagaaattggttcatcacaaagcagaaattccggatgaaccgataacgcccttgcaataccaatgcgctgacgctgaccaccggaaaattcatacgcatattttcccatatcgtctgccttcattcctactttttccagcaaacctacaattcgctgttccatctctttttcagaaagcttttcaaaaactgaaatcggctctgccataatttctcttacattctgatgtggatccaatgcggaataaggatcctgaaagataatctgcatccgtttatggtaggaaagaagctcttttccttttatttttgttatatcatctccatcataaattaaagtaccatccgtaggttcgtacatacgaatcagcgttcttcccaatgtggattttccgcatccggattctcccaccagaccaaatgtttcccctctctttatcgaaagactcacacgatctactgcttttacctgctgtatcgttttcccaaaaaaattttttaccggaaagtacttcgacagattctttgcttccaggagatattgttcttttatttccatagttatttctcccctttcttctcttgctcatccagttcttctttcgtaaaaatacatctggatgactgtgtttctgaataggaacgcataaggggaacttcttttttacactcctcacaggcaaatttgcatcgtgttacaaaaggacatccttctggaggatttgccaaagatggtgccatacccggaatcggttccagacgttctcggcagccactttcacatttcggaattgcatgaagcaaagctctggtataaggatgggttggattttcaaaaatttcttctgttgttccttcctccataataagtccaccatacattacttcaatccgctttgccagagaagctaccactcccaaatcatgcgtgatcaaaataatattcatatgttctgtttcatttaactgttttaaaagctgtaaaatctgtgcctgaatcgtcacatcaagggcagtcgttggttcatctgcaatcagaaggcgtggctgacagcacaaagccatagcaatcatgactcgctgtctcattccaccggaaaattcgtgaggatactgctccatacgactttcaggagaagaaattcctacctttgcaagcatatccactgctacttttcttgcctcttttttactcagcttttgatgacgacacaagacctcagtcatatggcttcctatttttttcagtggattcaaagctgtcatagggtcttgaaaaatcatagccatgtcttttccgcgcatcttttctttttctttctctgacatggataataaatccttctttaacacttccagatggtctgcctgtatctctgcattttctccaagcagtcccataacagatttcatcgttacactttttccacttccggattcccctacaattgcaaggatatccccttcatccacataaagagaaacccctcgtactgcctgaattttctgtttatgacttttaaatacagttgtcagattgtcgatggttaatactctattttcattcatcttcttatctcctatttactttcatccatcacacgcggatctacataaatccggagcagattacccagcttgttaaatgcaaatatagtcagcataattaaaagtcccggaataattgccatataaactgcattttgcagattactctgcgcactttgcaataattttccccaggatgacaaaggttcctgaattccaattcccagaaagcttaaagaagattctgtcataattgcatttgaaatacttgtcgttgctgcaataataatagtaggaagtacagatggaatcagatgtctgataaccattttaagtaaggacacacctgtaaaatctgcatataatacatattcccgctcctttacagacattacctctgcccgaacaagtcgtgcaatctccatccaggaaaagaatccaattacaataacaattgataccagtccctgtttaaaaaagatactgacaaccgtaaccaaaatcagccatggaatagattgtaaaacatctacaatacgcatcagaatactatccacgattcctccaagatatcctgccagaatcccaactgtcacaccaatcgtaatactcatcaacatagcaagaacaccaactaataaagaaatacgacctccatagattacacgagccagataatcacgtcccacttcatctgttccaaaaatatgaacactgcttggtgcctcaagcatatgagagacatctgttttatttggctctaacggcagcacgggagccagcaaagataaaatcaaaataattgcaagaaaagcaatcgaaaatattgctattttatcatgctttaatgcctcccagacattttccagacgttttttttgagaatcattcattgccatatacttacctcatctttctaattcttggatctgttacgcaatataagatatcagacaacagatttcccagaacaaccaatgtggaagacaaaatcaggataatcataacgataggataatccattccctgtactgctttaataaagtaaggtccaattcccggccagctaaatacggtttctgtaattactgcacctgttaccagagtaggcagagccataccaagttttgtgataaccggaagcaatacatttttacagacatgtttaaacataatttccgtacgagatgctccaaaagccttttgtaccataacataatcttccgaatactgagtaattgtagaagagcgaacatatcggacattatccggaataaatgccagcgtcagtaccacataaggcataataaaatgtaaaaagaaatctcccagtgtttttacacctaccgtatgcataccaagaatcggaagaattctcaacctgtagccaaacaggtagataaacagcatcgctacccagaatgtaggcatggcaatccataaagaacaaattccatctatcagtttatcctgccatttatttttatgagaacctgccagcaatccaagtacaattgcaatcacataggcggtcagataagaaggaagaaccagtttgattgtgtttggaatccttattgccagttcatcaaagatattggttttcgttacaatagaatagccgaaatttccatttaaaattccctccagccagcgaatatactgcacgtaaaccggctgatcatatccatacttttcacgaatcatctgaaccatctccggagacatcttcggagttgtcatagcatcaattgcatcatagggtgccagatgcattaaagaaaaacaaagaattgtgattacaataatcagaggaatcgcagtaagaatacgttttacaatatactttgccatgttttctcctttttgctttttactcaaaaaaagacggaatccttcactttatttcagaagaattccgccctttgtaaaaataataaatcaatacttacttattttgcaattttcagattggaagtatcctcaaacgtgtacaccggaacaagtcctgcttcttttacaccttgaattctgttgtttacaaccagaatcttattattggaaataattggataaaatgcacctgtgtcttgaatagcagcctgcaattttgcataagtttcttttcttgcagattcatccatctcagaaaatccttcttcaaacagctgatcgattgtatcatatccactgtaatgcatagaattataagcagctccattcttaaacagacttgagaatgtatcagggtcaattcccataatataacctcccagatacatatcatactcattattcggatctttcattgcattagaaacagctgttgcgtctcctcccgcaagttctacctctacaccaacttctttcagctgctcctgaatcagaagtgcctgtgcagactgtaccgggtcactggaactatatccaagtttcaatttcagattacttactcctgcatctttcagcatgctctttgccttatctacatcctgctcatacttctctacaccttcttccgtatagaactgactgtttgtcggcaggaaagtatacggaatgctataatattcatccgactcataagctgcatcatccattgcttttttatccatagcaaacaacagggctttacggacattttcatctgtcactctgttacagttaaactgtaaatatcctatacgaccctcactgtaagaatatgctgtcagattgtttgcatccaaatccagttttttcacctgctgtggtgtcagctgataagcatctacttctccattctgtaaagccaaaatagcagtatctgcattctcaataatctggaatactacatttttaatagcaggttcacctttataatagttttcatttgcctcaaatttcagataagaaccagattgataatctaccagtttatatggaccggttcctactgaattcatgttataatcattatgttcaaagtccgttacatctttatagatgtgttccggcataataaaaatctggctcagcatttccatagcagtaggtgtttcaaatggaaatgtgaaagatacgatatagtcatcctttttttctacttttaccgctccctgatcatataccagctgggaatatgcccaacccagattttcttctttttccatagcctcataggtaaagacaacatcgtctgctgtaaatggttctccatctgaccatttcacatcatctctgagactgaatgtataggttttattatcatccgatacttcacagtcttttgccagaaaccagttgattccatctgcattattcatatacagcggagaataaatcatcttaacagtcgataatccccaacggtcagatgttgtaatcacattaaccgtttctgtcggatctccggaaatcgcataagtaaatgtgtctttaccggaagtttctgtagccgctgtactcttatctgaagctgttttactgtcatcttccgcaaccggatcttttcctccgcaggccatcagacttgcagcaagtacaacagtcagagcaaccacagatgcaagctttgtaattctcttcatcttactctcttcctccttattttctctctttttcagagtcactactcttcattatgctatcagctaaaaacaattttgtcaaacatttcttgtcccaaaaagaaatcaccacatcccggaaatcttacgtggaatgcagtgattttgtcatttttgatttttgattttttctctttttttccgtgtcataatgccaccgattctaccggtttcttttgcagagagactcttccatccatctttcaaaactctgtctaaaagcccgagttcttctgctatctcatatttcactttttcttcgggagtcagactttccaaatcaatctctttttgctttttttgactcattttatactcctttttccttatatgtactctcagaattttgagcgtacaggaattcttattcttttatacaggagtattgcctgaaatttttattttataccgtttctttttattttgggataataattgacgcaataatataagcaataattcctgttcctgcaccaatacagcttaagattacccatgccagacgaaccaacgtcgggtcaatatcaaaatattctgcaattcctccgcagacgcctgctaacatgtaattggttgatgaacgatataatcttttattcgacataataaattcctcctaaattcaaaatcttcctaatttaatatagttcatacagaaatgtaaaaatgaacgttacgattcaaacgttatctgaacatcccccattccacagtcaatgcttaattcctttccggtatcatttttatctaaaaattcatttccaaatccggaggaaagaacgttatctccaatctgaacagtacccattccaacctctgcctctgcactgtagtcctctctttttcctgccattttcatgtccaccgtacctgttccgcaggaaatatcacttacttttgcatctaatttcgccacagatacttcaccggcaccaacctctatctcacattcctgtgctcttaattcatcggatacctgcaaaacccctgcgccaacttccaggtcaagagaagctgcatttaatttgtcgataaccagttgtcctcctccgttcatttcaactgtcactgattcaaactgcatatcctgcgggagaataatctcaatcgggtctttttctccctgatgattctttccttcccgctcaattgaaagttcccggtcttctctgtcatattctacaacatctgcgctattataactctttaccttaattgaacttgcatttgcatccgtcttaaattccagataaatggcatttttttcttctgtttcaatacttaatgaactcacttcctctttgctaaattcatattcctgttttgcttcagtatctaatttcgcatagattgtttcaagcccatcagaatcaaatccttttccgtctgcaagtacattcactttttctgcccagccaaaatattgcatccctttatcctttagaacagaccagtccggaccaattatcattccggctaaaaacaatcctgctccaatcaccccaatcacagctgacaaaatcagacatgtctttgtaaacattttcatacacgctgccctccttttcttcccttgtaaaagattctctgaagaaaatcaacgcatcctcgaaagactatcggaaatccttttccaactatccagagaaagactaacaggattaaaattgcaatcgcaactgctaccataccgcccccggctacaattaaaaagattcccggggatgaaatcaaacgaatgatagctaaaacaattgcagtaattcctgcaatcaaaagtgcgacacctccaatgccaattgctgcaatgattcccagcactcctacaatcaaaccaaataaaacacctaaaatcccaagtcctccgccagcccagattggagaagttaaaataacaagcactatcacaagtccccaggtaagaccgcttcgttttttctgtgtatgctgtccatatctgctttcttcctgatgataatgatttgtttctttgagcatatctttcttatcaaaacgcacatcctgataaccctgttccgtatactcttcatagtctgcttcatttccggaaaggtctgctttgataatcgcagccaccttcccggggcttcccagctcctgaatcacctctgcttctttctcttttccggcatcatcaaagtatccattataatattccaatgcctcttcccgctcctgcgcaggaatgtcatacaaaagtcgttccagctggcttaaaaattcctctcggttcatactcacaacacctctccctcaaataatccgctaatctttcccgaatatgttttccattcttctttatacaaattcaattgtgccattcccttttctgttaccttataatacctgcggtttctgcctccaaattcctggtcataagtttccagacaatcatcttttaaaagccttcgcaaaaccggatacaacgtagattctgaaatctcaagcacctgccgtacatcctgcgtaatcttatacccatacgttccctcggcttcctttgagacaacagcaagtacaattgcatcaagtaatgctgcacctgtattaaaaaccatgtatgctttcacctctttttttgtagagttatttcttatacaatactatacgtcatataatatagttttgtcaataatattatattaaataaatcttaaggttttataaaacaaaaaaatggaaggttttttatttttctaaaaaaccttccattttctttacgctactttctttactctaccgcaaatgcccgctccaaatttacagaataaatatatttttcttccaccggcttttccaacatccgctccagtgctttctgatagtatttcagctgaattccatactttccaaccaagtcactgccatcccgctgttctacataatctgtcttgtaatccaacaaaacaatttttccattttcttcaaaaaatgcatcgatgattccctgtaccagcatcgtctcttctcccgtctctgtttttaagatatctgaagccaaaacttcaatgacaaagggctgttcacggaataaacatccctcgctttgcgcctgtttcattcgttttccaattctcgaattagccagtgcaaaaatcttttcaggttttactgttacataaaccgattcatctattttttgttcttctctaagttttgcaagctgattttttactgccgttttggtatccgtatctgtaaaatccagccactgcagtaccttatgatacgcatttccgcggtctaccccgactaaaacctcgccttcttcctgcataaatgccggaatatatggttcaatttccggcaattcttttatttcttccttctcgtctgcaagaagttcttctccaagaatctgatccataagggaaactctttcctcaaaggaaatgctctcttcaaaggaaacactttcttcatcttcaaactgcatccgtttgacttctgaaactgttaccttagccggaacttcggcttctttctgccacggatattcccacaaaaaatgttcctgtatttcttttcttattcgttcatctgaagatgcacgctccatttctgcaatcaattcctgctctttgattaactgctcacttcgctcttttgcctcacttaaaacaaactcaaccggtgattttacagcaatcaaaaatggagctgtttcttcatgcaatgaatgactcacagggcaggaatattcatactgctgatacaatccatccatacagcggtgtcttgcaagtgccggaaaaatccagtccagatacattctcgctttcacaagttttccataagacagacgcattttttcttcattttttatcagttcaagtccttccacacgtttctccagtctgctgactgccccagtcagatataacttttcttttgctctggtcaaagctacataaagcactcgcagttcttctcccagattttcaagctgaatctggcgctgaacagctttctttaataaagtcggtgcttttgttctgcgttttgtatcaatccagtctgcaccgattcccaaatccggatgaatcacaagtgacgctctggcatcctgctgattaaacaattttccaagcccggatacaaaaacaatcggaaattccagacctttgcttttatgaatactcataatctttacggtattttcctgacttgccgtgatgtctgcttcaccaaaatcaatctggtatttctgcaggttttcaatataacgcacaaagttaaacagtcctcgatagcttgttttttcataatctcttgccttctcaaaaagcatctcaagatttgcttttttctgttcgccaagcgcatttgccatataatattctatcagtccaaggctctcataaatatcccataacagctcatggattggtgtataggcaaccttcacacgcagggtgtaaaactgttctagaaatcggctgatttttctttgaatttctgccgctccgtctgttttctcatataacaacatacattcaaagaatttaagcgtctcatctgaactttcttttcccgcacattttatctttgccagttcttccattgtaaaggcatccggcagatttaaaagcactccggcaaatggaatatcctgaagcggattatccagaatccgaaggtaatttaaaacagttacgacttcctgtgccgagaaatatccggtctttgtcgttacgcttgcaggaattccacgactctcaagaatctttttaaaattttctgcccaaccattcatggtgcgcagcaaaatcacaatatctccatactctgcttttctataaccgccattttctttatctacaaccggaaactttccaacgatttcctgaattttatccgccacaagtcttgcttcaagttcctgcacattttcttcggtttccatctgcttccattcggcttcatcgctttccaccagcaaaagttctgtttctcttaacaccggctcactattttcctcaaacaccgctccggcatagagtgccgcatcttcatcatattccactccgcccagactctctcccattatctggtaaaagataaagttgattcctgctaaaacttcctctctgcttcggaaatttttatgcaggtcaatccgcaccttatctccggctttctgcaaatatgaatgatatttttccataaataaatccggtcttgcaaggcggaaacgataaatactctgcttgacatctcctaccataaagatgttattctgtccctcttccatccttgataccgcagttagtaatttttcctgtaccagattgctgtcctgatattcatcaattaaaatctcataaaaatgggcagaaagttccttcgctgcctcacttcgctcatccccattttccgtatgatgaatcaaaatttccagtgcaaaatgctccaaatccgaataatccagcagattcttttcccgttttttctctgcaaatgcttccgaaaaacgaagcgtcaaatcaattaaaaccccaaccggtcctccggcttcctgcagatatttagctgctgtttcaaacggcacaccaaagtactgttctttgatttcatttaaaccgtctttgatttgatttcgataattttttaccagttcttttttattttccgatgcttccggcattttttttcccgataatcttgcataagaaagatgggaaaaaacctcctgctgtgcttcgaaactgtctgcttttaacagcagttccactgtttttaaatcctgacttaaggcttcttcgtaaagatatggtccatcttcctgccgacaaagtgcaattcctgcttctgcaagcatacggatttcttccagatttttttcgatatcggactttaacaactgcatccacggtgcctgctccacttcttttactgacgaaatctgatatgcatctttgcaggataccagccattcttttggatacggataactcgtcgaaaaagtatacaatttacgtatcaattccaccaacccatcatcagaacgccctgtggaaaacgcctccacaaactcatgaaattcttcactgccctcttcataagcctcgctcaaaatccgctcggccacatctccctgaagcatacgcagttccccttcttctcccacacgaaaagacgggtctaagtcaattaaatgaaaataatttcgcacaatatacgcacaaaaactgtcaatcgttgtaatcagcgcatgatgaagcagggtattctgctttcttagatgctctaacatctgctcttttttcggactgtcttcctgcttctcttcttcctcgattcgagcttctatcgcaagtcggattcgctctctcatctctcctgctgctgctcttgtaaaggtcacaattaaaagctcatcaatcgaaaccggatgctccaaatctgtaatcatcgaaaggattcttgccacaagcaccgctgtctttccacttcccgctgccgcactgactaatacatttgcatttctcgtctctatgactttctgctgttccggggtccatttcatttccatttatttcttttcccccttttcattttctgctttttcgctctcctgcatctgctcttccatgcctttccagatttcctcactttttacctgcgccagtctgcggtatccacacccttcttttttctcatcaaacccacacgcaccttgatatgggcaatactgacaggcatttctttgtcccatctcataaggtgaaaccgacgcttctccctttaaaatacgctgtccgatttcctgtatcttatgtttgacatagcctgaaaccagttcaaaatgttcctcatctaccgcactggaagtcttagaaagtcctccgcttttattgatagaaactggaatactgtttgaagatacccctttttcttcgagtcccttgtccagacgttttaaaatctccgggtcggcagatgccagtccattcattctaagctgctttaacagtctctgatttaaagactcttccgattccttttctacacaatctacaatcgggtctttgatattataataaaaaatccctgccggaagtacgtttttatccggatgagctctttgttccagttccattgccgcatttaaatacagcaccagctgaagctgaagtccgtgatacagtgccactaaatcaaacgcagtacttcctgatttatagtcaatgacttttacatagacattttcagaatcttcacacacatccacacggtcgattcttccctttaatttcattgtctcctcttctgaaagcgcaatattaacgctttctaacgaatctgccattgcaaaggaaacctcaaaccggctcggtttaaattcgccctgttccatctgttttgcaagtgcccaaaccgttcttcgcatcattcgtttgacacgattgaccatataagcatttctcgcatcactttgaagcacggtattcccataggaatcaacggcttcttccacacaggaatctgcgagtttttccatctcttcgagactgatttcatcccattccacaccctgttctttgatgtgtcttgcaaaacgttccaatccagaatgaagcacatttcccatatccattgcattaaattcataggccgtacgttcttttaattccagcccgtaagagaggaaatgtgcacaggcacactttgcaaaaagttccagtctggtcgcactgttttccagtatctgtccatacagtgcctttgccacacttcttccgatattatcagcgattttctttggaaatgcactcttcatcagaccttttactctctcctgccattcttcctgtgaaacaaaccacaaaaataattcctgccagtatttagacggtgtctcttttcggatattctgaaaacctttggcaagatatgcaaatgcctgctccgtcttttcaaatgcaaaactgtcattttgtctaactttttccaccggcaaatccgcaaacatctttcttaaatttccaatcaaaaaggaaggaagtattgcctctccatctgccccctgcttgctgtaagagaggaataactgatttgatggcttcgtcagattcaaatacagataaaatttctgtgtatacagattttctttcgcagttggcgcaagcgctacttcagacaatttcaaatcttcacggtttaattctgataaaatttttccaccaccatcttctcttggaatttttccatcattgactccgacaaaaaacaaaacctgaatgtcttttaaacgggttcgctccatatctccgaccagcacctgatctgtacttggaggaataattcccacctttgcctcagaaagccctgcctctaagagttctttaaactcccttaaactgacactttcttcccccaaaacctgcaccattttatcaaataaatccatcacaatggcataaatctgactgtattcttttgcctttccaacctctccgtgtgcctcaaaatactgctcacttttctttaatttctgctgaattctgcatgaaacaataaactcataaaaggctcgcacacgctccgataccgtagcttttcgcactttcatacgcaaagtaaatccttccaaaagctccatcagacgaactcttaaagcttcaatttttacaacttcctctggattttctccccgataagctaatgtccactccttctgccacttcttccagctcttaatacccattccaagcatatagttttctaagacgtccatttcttcttccgtcaaatccaaaagcccgcatcgaagaaaacgaaacacactctcatagctataattttctatcagcatatcaatgcaggcacgcagaaattcaataaacggattcataagcacagtctgtttttcatcaataaaacacggaatttcgtaacgttccagcatcttctttgcataatctgcgtaagtatccatgtctgccgtaatcactgcaaaatcacgccaacgcatcttcttttgacgtaccatccggtgtatcattccggaaacatattccatttcttctttgggattggcacattccaaaacccttatcgaatcctgtctttcggtataacagtttcttttagaacgaaataaattctgctctaaaaatgccagtgccggctgatggaaaaaccttgcgtttcccttaattttcacatcgtccaccggacagccgactcttgacgctgtctggcacaatctactcaccgtctgcttacttaaataaaacagattcgtcgcatcactctgcacataaggacgttccccttccccgattgtaaccgtcacatacatttcttcgcagaggggcagaatcttctccagtacattttgctgaatcggtgtaaatccggtatagccatccagaaccagtatgctctcttttaattttttcgactttccggctacacttccaagcacttcaagcacttcttctcttgtgattgcttttccttccagatactcaaaaaagccgtcataaagcactgcaatatcctttaatttatagtaaagttccggcttatcctttgcacactccagcattttttccatgtcttcttttgagacttcatactgccgaagctcagataccatggatttcatttcagagatataaccctgtcgtttcattttttcgccaagcacacttaattccttcttatgattttgtgccacttttcggataaccagactctttccggtctcttctaacacatcctcacacagataacctgtttcttctaatactcgaaaagcaagacgttcaaaacttaagacatcaatatttaaaattccttttcttggatgcatccggaccagttctttctgtgtctgcatcgtaaactgctctggtactaataccagatattgcttcttcggattctgaatggattcccgtataattttctgataaatataataagattttccggcacccgatgcgccaaacacaaaatgtaacgacatgcgtttcccctttcttacaactaactgtttctgtcttttactttaggaaaaatttttcaatgacctctgcaattccatcctcatcattactatttatggtaatataatctgccacatcttttactttttcctgtgcatttgccatagccaccccaagacccgcatactgaatcatggaaatatcgttaaatccgtctccacagcacaccatctcttccctttcgattccgagaatctttaacagacgttccagacaatatgccttatccacatttttcggaagcacctccaggaaatatggttccgaacggaatacctgcgcttctaactgatatttctcggcaatgactggttcaatactctctaataattcaccgtcagccgttaaaatacacttgttaaccggaaaattgacataagatttaaaatccggttttttaatcacaggaagtgtcgtaattctggattctatcataatatattcatccggtatttttgcagaaataatagaatccccctcataagtcataagacccgttccataatgcatggcatcgtcatataatttctttggaatcccaatcggaagttctttcgagtaaatacattcttttgttttccagttaataattcttgctccgttaaatgcgagcacataacttccatactcagcaaaatccagttcatctgcaactgccacaattccctttgtcggacgacccgatgcaatcgctaccggaatcccttttttttgaagttctaaaattgcttcttttgtcttttgggtaatctctttcttagaatttgtcactgttccatcaatatccaatactaataatttataactcatttttaaaaaatcctcctcaatttctcagatgtttaaccaaatcaagtaagtcccctgcttcaattgcgaaaagcaataagcaggggtggggacttgcttgtatcaggagggggcaatccccttctgataagctgcgtagcagctatttggttatgagcaagtagcgaagcggattgcgaatatccacttgactctgaaaccagtttaacacaaaaagttttctcaaccaacctcgttgggggcatatttttctttttctcctaataaactatgatgtgagtgtcaaaaataaattttgccactcgctgatgtatccggattgcttcattgctacgcaattctcacaatcctcgaacacctcaaactctcataaaatggcatattcataccattttattacgttttcgttgttcggcgtgtcaattaaatataaattgctttttatgcaagcacaaccgcaatttatatttttgacacttacatcaagttataaaaaggaataccaggagggaatactatgagtgcgaaaaccaaaattgttgtactacatacgaaagaagtgatttataccgtgctttttgttgtactcgccattgtgcttgcagtccttctttttttgatgttcggaaaagacaaaaagaccacttctttctcaggctctcccgccaaatatcacgccggtatctataaaagcccaattacgctcgataacaacacctttgatgtcgaagtcacggttgatgaacatgaaatcacctctatctccatgacaaacttaagcgaagcaacaactgctatgtatccactgatggaaccggcactcgaatcccttgcgaatcagatttatgcaacccagtccacaaaagaccttacttatgccgaagaaaataaatatacttcgatgctgttgttagatgcaattaactcggcacttgataaagcaagggcagattaagaagatctacaaaaaatggctccgaacaaaagtccgaagccatttttgctgcctactatgtacttattatttaattgcaccttctaccataccctgaataatctgtttctgtgcaaacaggaacaagataataatcggaatcatggcaagcagagctgctgtcaggattaaatcccattgttttacataagaacctacaaaactgcttactgcaaccggaagagttttgattcttccgtttaatccaagcatcagagatggaagcaggtaatcgttccaaatccagataccatttaagattaatactgtaacctgaattggttttaacagcgggaagataattcgaaagaatgtaccctcaggactgcatccatcaatccatgcagcttcttccaactcatacggaattccttttacaaaaccatgaaggatgaatacagacattgaaccaccgaatccaagataagcaaaaataattcctttgtaactttgaagcatctgaattcccaaaaactctgaagtttcacggaaagtagataacagtggaagcattacaacctggaatggaataaccattgctgatacaaataacataaaaatgaaattagaccattttgttttatttcttactaaaacccaggctgccatactggaaaacagagtcagtaaaatcagagatactgctgtaatcaacagggaactaaagaaagaaccccaataattaaagttatcattatggataacattgctcatgttggtcaacagctgtccccagttttttggtaaagaaatcgggctgatgacaatacttgcactatcctttgcagagttgattataaccagtaagaatggagctaacatcacaattgtcagaagaattcctacaatctcagcgattgttgttcttattttctgtgctttcattacatttcaacctccttctttttactgattgtaacctgtgtcagagacacaattgcaagaataataaagaatataaccgctttggtctgaccaagtgcatactggttctttccaatcgctgtattataaatattcaatgctaaaaattctgtagactgtaccggttttccggaaagaatacgagtcggtgcaccattggtaatagcaaggttcaaatcaaactgtttaaatgagttaaccaaagtcaggaaaatacaaattgtgaatgtatttgcaatcatcggtactttgattttcagcagagtctgaagtgtatttgcaccatctacattggatgcttccagaatatcttttggcacactctgtaaaccggttacataaatcatcatgatatatcccgcatactgccaggtacttacaattaaaattgccacaagcgcaaggttcgggtttgtcagcatggaaacacttcctgaaattacagaaaccgcaactttattgaaaatgaactgccatacataaccaagtacaattccaccaatcaggttcggaatgaaatatgctgcacgatagaagttacgaccttttacttttgaagtacaaagcagtgccagtgcaaatgctacaatatttacactcagcatattaattactgtgtaaataaaagtcacaacaaaagaatatacataatccttagacttgaacattgcaatgtagtttccaaatccaacaaaattatcatattttattccgttccagtctgtcaaggagtaaaagataccacaggcaaacggaataagcacagttactgcaaatgcaaacagcagtggaaataaaaataatacataaataattgaacggtgtttcttcgttggcagcaggtaaagccctacaataagcaataccgctcctgcgattaaaagtcctccccgaaaggaagttcctgttctcataaaatccatgtacagtgccgctgccattgctatgattccagccacaattgctgcacatgatattgcttttttcgactgattcattcctaactctcccatcaaatatttaccggctgtcttataacaaagacagccgataaaacctattatttacttgatgctacataatctgctattgaagaagccattgtacttacaaatccctctttatcaagctgaccttttgcatacagctcaaatacaggaccagttgcattcatagccatgttatccggctgtgttacccaatcccatgcataagtttttccagattcaatataaggaagcatactctgtgcaagtggtgtagaaggttttaatgtacaagatttaaatgtagaaaccataccgcagttttctacaagtgctttctgaccttcttcggattcagcaagtgcttttaagaattctttacaagcatcaattttatcactcttattgtaaattccccataaacttggtgtatcaacgataagaccgtctgtatcttcttttgtaaatgctgatggagcaagtccacatgcaaatgttgcatcataagttggtaaagatgggtcaatccagttaccctgtgtgataaatgctgcttttccggttgcccacagagccagctgatcatcataagtaccggaaatcaatacattctggtctgagtaatcaaataataactgtaaccagtctgcgaactgtcccattctatcttcatcaatttttccttcattgtttaccatatcaatatatgttttatcatcacggtcaactccctgtgaataataagctgctaataagtggttaccggttgaccagtacatctgtccggattctgctgcaactgcacaaacagatgtcagtccaagttcatctttcataccgtcaattttttcaaatgctgctttataagcatcaatgtttgtcagagtagaaggatcaattcctgctttatctaagatatctttgttatatgcaagaccaattccttccagtgagaatggcataccatatacttttccgtcatctcccttaaatgcgtaatcagtatcttcaatccagtcttctccgtcaagtggttctaaccagtcactgaaagaagatttataagagtcaggaccaaatgcaaagatatctggcatgtttcctgctgcgtagtagtttttcagctgaccatttacgtcaacaccgccacctaaagattcgattacaacttcctgtccggtttcttcttcatactgttttgcaaaatcttttaaggccgagtcaatttcaatttttgtatttacaaaacggattgcatctttattggcactgcttgaagctgcgctggaatcactggagctgtctgaagaactgcttcctgaactgcttccacatgcacctaatgtcattgtcatcgttcctgcaagtaaaactgctaaccatttctttttcatctcttttaccaacctttcttggaattttcatcttttttctttatcacttatgcgcataagttcttgatgaaattatcatagcacccctttcgttaaaaagcaatactttttatatgccattctatacatttctacattttcaccagtattactacttattttcatggtattgcaacctattttttgtatattttgcagtaataggtttttcgcaaaaccttttttcgttcatttttcgtttatcttatgcgcaaaagtaattccatttttcgacttttttcattttgcgcataagtattttgaagtcaaaaaatgacattctgctttcggcaaaatgtcatttttctgtctcttattttctatattcttaaattttttttacagaatcccgaattacaagttctgttccaagctgaacaattttatcttcggattctccctctatcagttttaatagttcctctactgctgcaattccttttgcctgaatgtcctgtcggactgtcgtaagcgccggacgcaccattcttgaaattggaacatcatcaaatcctgcgatggaaatctcttccggaatttttctttctctatccaaaagcatattttcaatgtgtaccgcataataatccgaagcacacagaagagccgtatacgaaaatgatttctcataaatctcatccatattttgaggctctcctgcatcgctggcataaatttgaataaaattttcttccctacttaccggaatgttcgcttcttttagcgccctgcaaaatccctgaaatcttattttatccagatttaccaagttatcagcaaggaaagcaagctttctgtgaccacacgaaataacgtattttgtcagcaaatattccgcctgttcatcctcgatcctgatattgacacagtttcccagaccatttgtatcataatcatcaataatcgcaatcggatttttaaggcgctcttttaaataacggatatcaccctctacaaatcctgaagtaatcagcccgtccatgttccaggacatcgtaaactgctgaacctgatgcacatcgtcgactgcatataccatcaggtaatatcctttttgccgtacatgcctttcaatcgcacctaaaattctaccaataaatgggtcttcaaatcggttcgctatcttattctgttttgatttaatcaacaagccaataatctttgatcgtttactcgcaaggtttcttgcattgatatttggtgtatagtcatatttttttaaaattttctgaattcgttcgatattagccagtgaaacttcttttgtcttgccatgaataacattcgaaacagtcgttgtgctgactccgagctcctgcgccatttctttaattgtaaccattctttactcctgtttttacactgctcttctgactgctcccacaggcagacctatggattttcgccataatttatagcagttttacttctatttttttctcacgacttccagtatacacacaatttccacctttctcaatagtgattctgccataattgtccggattctcataatcttttcccattccatcatcttcataccacacatattcggcttttgtctttacaaatgccagtgctttgacatggtcacagtctacttcatctgcatactcgccaccatctgtcagtaccaaaattttatccggacgtacgaaaactaacatttcaaacaagcctgcttctacatagtgatgtcctgccgggagaatttccgtatcgtaatcatccacgcctctaaagcgaagcattgccatttcctccggaagatagacatatctgccttttgcattctggttataaaccggagcaatcattaaactgtctccaaccaaaagctggtcttctacctgagaagcaaattcatcatctgtatatacaaaagataatggtttgaagtacatttcactgtttaaggcagatttcatatactcgctgtaaatataagccagcagaccatagcgaatattaatgatttttctaaattcttctacatggtcaaaacgatatacttcctgttctcttgttcccattgcactgtgatttctcatcagtggagagaacatggcaagctgggtccatctcatgaccaaatcttccgttgcatctgcaccaaatccaccgatatctgcaccggtataaagaattccaaccatgtttaaggacggcatcatacgcagattcaacaacagatgattccaccaggatttattatctccagtccagattccaccataacggtgcatgccaatataagaagaacgagagaacattaaaattcgtttttccgggctcaggcgttcaaatgcctctcctgccgcacgggtcatattataaccaaacaaattatgtactttatcgtggcgcatcatttttccatctacgttatgatagaacttcttaaagtcatctgtattgtttgccagacttccaaccagaccggtaaactgctggaacgtatccagatcaaggtttttatctttcaattctgcaatcttatcaaaggtttcatccattctatcctgtgcaaagaaaatagacggctcattcatatcattccagaatccttcaattccctggtctaacagcacctgatatttatttccaaaccactctctcgcctctttgtttaatacatccgggaaatgcacttttccgggccatactccggctacaaagtattctccattttctttcttacagaaatagcctttttcaatgccttcttcatatacgtcatagccttcttcaacttttacacctgcatcaataatcggcactaaatgaatgtgctgtgctttcatctcttttacaaactcaggaaaatccggaaaacgttcctgatttaccgtaaagtctttaaaccgctccatgtaatcaatatccatgtaaatactttcaagcggaattttcttttctctgtgtccttttactacttcacggatatcagcttcattcatataaccccagcgactctgctgatagccaaatgcccacttcggaggaatatagcttcttccaatcagctgacgaaactgttttacaatgtctaaaatgctttctcctgtcattacataaacatctgcatccggttcacttaatgtaatttttaattcatttaaatgcgtatatcccacatcaaatgtaatgattcccggataatcaaaaaacacaccaaattgctcttttcctccatctaaaactaagaagttatgagatgcatataaagaggtacggtcctctaaatggttcggttcatctgcgcagcagctcttataaatccagcctctcttgttaattccacgtacattttcacccagaccatacaccttttcttcgttttccagtgtatactcaaactgaagctgttcctccgtttttgccactgtaaaatacggaacatccccgttctgtacctctaatttttgtaccactgcatcggtctgaaatggatttccataagtgtattttgttatcatgtcttaacttcctcctttattttttatgtactctcggactctttctgcctttacacatattagcccattttcagttccattttttgtatcatagcatggcattttatttctatcaatcccttttgcgcataatccacatgtgatacaataatttttccagtatttcggcagtttttcagtttattttccgcaatttcagtcaaatatgccaaaaaactgccggtgttgtccgacagtttttttgatttttattttctataatgtttccaactcttcaatccagattcgaacacaggcatcacttggcattcttaaatctcctcttggagaaactgccacacttccgaccttcggtccatccggaagacaggaacgtttaaactgctgagagaaaaatctccaataaaattttttcagccattttaaaatcacttcttcttcgtattttccttcaaaggctttttttgcaattcggtaaatttttttcgggctgcactggaaacgaagtaaatgatacaagaagaaatcatgcagttcataaggtcctaccaaatcttctgttttctgggaaatcaccccatcttttggaggaagaagttccgggctgaccggagtatctaaaatatccagcaaaatatcagaaagtgcttcttcgtcgcaggtgtctgcataatatcttacaagatggcgcaccagtgttttcggcacagaagcattgacgccatacatggacatatggtctccattataagttgcccagccaagcgcaagttcggacaaatcaccggtaccgattaccattccgccaaatttattagcaatgtccatgatcacctgagtacgctctcttgcctgtccgttttcgtaagtaacactgtggtcagacgggtcatgtccaatatcttcaaaatgctgagtcactgcttttttaatatctacttcttttaaggttgccccaagacgttttgtcaactcacaggcatttgtgtaagtacggtccgttgttccaaaacatggcatagtgactgctaaaatctgttttctgtcaagtccgcataaatcaaaggctcttgccgtaaccaaaagtgcaagtgtagaatcaagtccaccggaaattccaagcacggcgcactgactctttgtgtgttccagacgttttttgagtcccattgcctgaattgtcagaatttcatcacatcttctgtctctttccccttttgcatccggcacaaatggatttgcatcgataaaacgttccagttttgtctcggttacatttaaatgaaatggaatcacctgataattttcttttccctctgactgccaggttgtattttttctgcgctctccgactaaacgactcatatctaacacactgtaaatcgtttcatttgcgaagcgttttgcttcttttaaaatcgtaccattttctgcaattatattatgtccgctgaatactacatcctgcgtggattctccatttcctgcggaggcataaatataaccacaaagcagtcttgcagactgaccggaaaccagatttcttctgtactcatcttttccggtcgcctcatcactcgcagacggattgataatcaaagtagcaccagaaagggcatgagaaatacttggcggattcggtgcccacaaatcttcacagacttctactgctgttacaagctgtggcagttcttcacagacaaataagagattttgtccaaaaggtacttctcttccgtaccagtttaccattccctcaaatgcacggcctgctgtaaaatgacgtgcctcataaaactctgcataattcggcaaatggtgttttggcacaaatcctaaaacttttccacccgaaattacagctgctgtattatacagcttctggttaaattccagcggaagccccacaataatcaagccttccacttcttctaactcttcttcaagtttgtgaagttcttccttcgcacgcacaagaagcagttcctgccagaacaagtctgaacaggtatatcccgtaatacaaagctccggaaatgccatcacctttgttcctgcttctgccatttcttttactttttttacaatctcttcccgattgtgcacgcaatctgccactaaaatatccggcgttgcagctcccacttttacaaaaccgtctctcatctcgtacccgacctttccttatgctcttgtacagcgttttaaaatacttttcagttcgtctactgtaaagatataatttttattacagaaatgacaatttaactcaatttcttttccatcatcaatcatttctttgatttcttttttaccaacactgattaacgctttttccacacgttctttactacaattgcaatggaactgtgtcggcactgtctccatgatttccacatcgaatccatctaaaatcaattttaataaactttccggtgtatgtccttcctctaacagactggtaacagaagttactttctttaagttttcttctaatttgttaatcacttcgtcatctgtaaatggcattaactgaatgataaatcctcctgcctgttttacggtattgtctttttccatcagcactccaagacctacagaggacggaacctgctcacttgttgcaaaataataagtcaaatcttccgcaatctcactggtctgtaaaacagtctgtcccacataaggctctttcatccccatatctttgatgacgttcataaatcctacgccaaccgcaccggcaacatctaattttcccttgtcattagcatgtaaaataacatttggatttccaacataaccttttacatttcctttggagtctgcagttactgtgattccctcaagtggtcctcctgctttaatctgaagagttaaaatatctttttcccccttcatcatcacacccatcatgcttcctgcagtaagaagacgtcctaatgccgctgttgccaccggacttgtattatgtgctgctctggctgtctcaactaattcttttgtggttgccgcaaacgcacgaatctgattatttgcggcagttgctcttacaatgtaatctcccatttatttccaatctcctaatttttcttttttccatgttctcttgcaatcacataaatccgttcacttttttcattcaccggatttttcgtaaatgcatcataagccgtaacaaattccattccggctttttctaacaattcttttaccagctccaactcataagctcgctgataatgaacttcttcatattttcgataaagaccatccttgccctccggaataaacaatgccaaatcatattcattaatttgttcttcttcatcataataattatcccagataaagctggcatcctcgcgattctccgcaatcgtctgttctccaaggattttttcatacttatagacggtatttaagtcaaaaataaaaacaccctccgggtcaagataattgtttaccagtttaaatacttccagcaaatcctcatcctcggtaatataattcatgctgtcacaaattgagacgatcgcttttactgttccatacaattcaaactcccgcatatcctgacaaagataaaggatatcctgaccttcttcctctttcttttccagtgcaatttccagcatatccggtgcattatccacaccaatcatatcgtatccggcatcggagagcagtctggtcgcatttcctgttccacagcccaattccagtaccagtccgtcatctacttcatattcttttaaaagcccagtcaggtagttacaccactccttgtagggtatgttatccatgaacatatcatacacccgggcaaaactttcataagcgctcaaaaatcattcctcctgtgcacatattcttttttatcttaacataaatcaggtttgcggtcaaaaaaaatcgactgtacccttaagcacagccgactaatgatttatgccctctcagaatctttgtatacacgtatcataaagactccaaacgttcattttatttttttataaacctgttttttctgcaatgaattttcttgctttgattgcatattctaaaggatttgcctttgcaggatcctgttctgcttctactaacatatatccttcataacctgcatcttcaagcactttgaaaatcgggtcaaaatcaatacatccatcgcccggtacagtaaatgttccaagacgtacaccctctaagaagcttaagttttcattttttactttttctactacttccggacggatatcttttaaatgtacatgtttgattctgctgacatatttttttaccatttcaagcggatctgctccacagtaagtaaaatgtccggtatcaaataataagctgacatattccgggtctgtattttccatcatacgctctacttcatccggattctgtacaacagttcccatgtgatgatggaaagtaagagaaattccgtattcctcttttgcgatctttccaagtttgttcattcctgtacagaatgtatcccactcttcatcattcattacatatttatgtccaaaaatcggagtgtcctgcattccctgcacactgtgactctgttcagaagctccaataatctttgcacccattgcctttaaaaaagtcagctgtgcacgaaattctttttctacttcttcaaatggttttgtgattaaaaaagaagaaaaccactgattacagatctccacgccacgaagttccaatgcttttttcagaacttccgggtcttttggatatttatttcctacttcagaaccggtaaatcctgcgagtgccatttcactgacacactgttcaaatgtattttcttttcctaaatccggaaggtcgtcattcgtccatgcaattggtgcaattccaagttttactttttctttattaaacattttttctatctcctgctgttctttttagtcaagtggatattcgcaatccgcttcgctacttgctcataaccaaatagctgctacgcagcttatcagaaggggcttgccccctcctgatacaagcaagtccccacccctgcttattgcttttcgcaattgaagcaggggacttacttgatttggttaaaaaaataccacgaaagtctctacataatttcagaaattttaaccggtctgtgttcttctaaagatttcttagctgccagtcccattaataccggttttaatccatccattacgttaagaggagtttctttatcattttcaattgcatcgataaatgctgcaatttcttttccataagcatccatgtatctctctaagaagaagaacaatggtttttcacctgttacaccatctgcgttgctgataactgcggaagactgactgtcatttttcatagaaaccataccttctgaaccaaatacttctgctctctggtcatatccgtaaactgcttttctacagttatcgataacagcgattgctccgttttccatctgaagtgtaataacagcggtatctacatctccggcttctccgattgccgggtctactaagtttgcaccctgaacataaacttctgttgcatcgcatccagctaagaaacgaaccatatcaaaatcatgaattgtcatatcaaggaacattcctccggatacttttacataatcaatgcttggtggctcagggtcgcgggatgtaatcttgataatctccggtttaccaacctttcctgctgcaactgcctgctgaaccgcttcaaagttatggtcaaatcttctattaaatccaacctggtattttacgtttgttccttttaaggcatcgattacttcctggatttttgcaatatcatggtcaattggtttttcacagaaaacatgttttccggctttgattgcctctaaggaaatcggggaatgggtgtctgttgaagaacagattaaaactgcattgatttccgggtcattgatgatttctttgtaatcttttgttgtgtgttctacacccatgctctttgcccattctgctgtttcatcatttaaaaatgggtctgcaactgttttaatcactgcatcttttactcttgttgaaatacttgtgatgtggactcttccgattcttcctgctccgataatacctacttttaccattttttcattctcctttttatgaattttattgtttttgttttctcttgcgtgcccgagcactttctctttatgttgttataataccattgcgtgcccgaaaacgcaactcggaattttgtacaattttaccaaaacaattctatctaaaattaccaaaagcaggaactcggcttctgcatctgattcgccgatagactggcaatatagcagaaaatagtcaagtggatatttgcaatccgcttctctacttgctcataaccaaatagctgctacgcagcttatcagaaggggcttgccccctcctgatacaagtaagtcccctgcttattgcttttcgcaattgaagcagggaacttacttgatttggttaaaaacaaaaaatgagaaaaattacagaacatgacaattttgtaatctttctcaaaatataatcagccgatattattattttcaattctaagcatacgatatccaatgccaatatgtgtctggatatattccactccatttttctcaggctcaagttttttccgcaaggttgccataaaaaccctgagagaagcaatatcgttatctgaacatcgtccccaaatttgctgagtaatatacatgtgggtcaacacctttcccacgttacgtgacaagatgcaaagcagcttatactctataggtgtcagatgtagttcctctcccttcagatatgtacagcctgccataaaatctatctttaactctccattttcaaaaatagatgttttgttctgttcatctgtctgtgttatcgtaagtcttctctgtgtaacacggatacgtgcaagtaattcctctactgaaaatggttttgtaatataatcatctgctccggcatccagcgcctctattttgtctgtatcttcacttctggcactgatcacaataatcggcatgttcgaccaggtacggatttttcttatcacttctactccttctatatcgggaagacctaaatccagaagaacaatatccggattatgggacgaagcctccaaaatcgccgaagagccgttttccgcaaccaaatatttataatcatgtgtttttaatgtagtaacaatcaaattacgtatgggtttgtcatcctcaaccaccagaattaatgttttattcatttaatgtcacctcgcttaatggtaaagtaaaaataaaattgcatccatgaggagcatgatccgtcagaaccagagttccattatgttcttctatgatagaacgacaaagtgccagaccaagtcccagacttcgatgactatccgcaattgttgtttttcctgtatagaacatctcaaaaatatgcggcttcatttcatccgggattcccggaccgttatcttccacacttatctgtgctttcccatctgctttgattccacgaatacagataatagaacccggtggtgtatattttattgcattatcaattaagtttaccaaaacctgtataataagacgtacatccatacgtgcaagaacaagctcttcacagtctgtcactattttatactcatcatgcttcttgttaatatgccgcagagactctgcaatcacttcatctaaaagctgatctgtaaatttaattttcagtcttccgtcattcagtctggtaatagaaagcaaattctccacaactccgatcagccattcagaatcatcataaatgtcagtatagatctgagcctttgtagcctcatccaaacggtcgccattgttaaccaacatatctgcattaccggaaatagaacaaagtggcgttcgaaggtcatgagagattgcccgcagaagatctgcccgcatctgctcgtttttggccaaaactgcatttttctctttttccatggcgttttgtgcattttccattgcaagcgcacattcatttattacagacagcaggatactgtattcaaaatagtccagtgtttctttttgcattggtattccaattacaccgtaaacattgtctccaccccggattgccagatataagcatttggcctgtggaaaatgatgagtggaagcaccggcacgctgcctgttttcatagacccatctggctacaccctgttcttctggtgttaatatattttttgcactctctttttccaccgaaaaaagttttccatctgataaatttccgttttccactacatacgctgtaatattgcgatttaataagcgaagaagctgagtacaggtaatatcaagaatctctgtccctccttttgccttttgcagcaggcaatctgtatcaaacaaaacttgtgtacgaaaagcaagctgagcagacaattttgcatgtgttttcagctttgctgcaagtgctcccgtaagcacagatgaaataagcattatgagaaaagttaccggataccctaccgcataagtctgaaaagacatcctgggttctgtcagaaaaaagcaaaataaaaaaacacttataacagatccgaccacactgcaaagataaccatctgtcaaaattgaagtaagcaaaactcccaatatatatatcgttacaatatttgtatccgtgaaattcagtctctgaaacagaagaccaatcaaggtacatactgcaaatataattaccgtgaggaaataatctttcgctgacggtttttctacataccttgcaaatgacctcttttgatgagttctggtttttagcgcatccggaataatatggatatcaatatccggtacaatttcaatcagtctttctgtcagagttgctttgctgaaaaagtgattcctcctggcattactttgtccgattacaatttttgttacattggataatctggcatactctgcgatttgtacaggtatgttttccccatgagtcatcactatctctgctcccagcttttctgcatactgtatatgttcttctaacttttctttatctaagacttctgattttataccagttcgtacatacaaggctgtaaaacgtgcctgcagcactttcaccattttggccgctgtatctattatttttttattggagggtgctgctgacagacaaaccagaatatgttcgcttagctctttattattctcctctgctttgaaactcatttcatcttccacccttttctgctgtttttaaaattatatcatgcgactgtgttatggtcaaaagtcttttctacctcctctgaatgtccatcaaaaatcaatattccttattccattaccatcacttattccatatcctcttcatgacaatcacgctatatacggaaacacttctgaagatcccgatactctcctaataccagtaatttattattctctgcaaaacatgtatccggagaaatcgaaatagtgaattctccttctttttttaccgccagaatattaatattgtaacgttttctaatatccagcccgcctactgtttttccaatccattcctctggtacttccacctcaaaaatcgcatgggaagcatccacctccatataatcaaggatatgatcatctgtgtaacggatagatgcccatttcgcaacttgcttttctggatagaccaccttatctgcaccgttgcgcaaaagaaatttttcctggacatcacgttccgctctggatataacaagttgtgctcccaattcctttagaagagaagttgtttcaagggaattttgaaaatcacctccaatcgtcacaaagcagatatcgtagttgccaatcccaagagatcgcagaaattcagcatttgtactgtccccaatctgggcattcgtcacaaatggcaacactttattcaccctttcttcattccagtcaaccgccataatctcatgcccaagctgattaagctgtatagcaatatgccttccaaatcttccaagtccaataatcaatatattcttcataatatttttttctccttatccaactgtaattttctctaaaggcagccttgcatttcccctgtttcttccggaaaatactgcataaatcagggtcaatccccctacacgcccaagatacatcagtataattaacacaacttgtgaaaaaacatgaagtttcggtgtaattcctaatgtcagacctactgtacctacagccgaagctgcttcatacagacagtccaaaagaggaatatcttcgtatatgctgattgcaagtccaccgcaaaaaaacaatgtaaaataaagcatggatattgttgctgcatttttaatcgcatgatattccagtctccgtccaaaagcccctgcattttcctggcttcgaaatgtagctattgcatttaaaagcagtactgtaaaagttgtcgttttcattcctcctgctgtagatcccggtgaaccgccaatcagcatcagcagtatcataaccgcacttgatgcctcactcatctctgaaatatttatagtattaaaacctgcagttcttgtagttactgattgaaatgtggcagctaacagacgctgccctgcaggcagatttttcaaatcatagacaaagaaaaaaactgccggaaggaaaatcagacatgccgtcgtcacgagaatgatcttactttgcatacgataacgtttaaagttcattttattcatatagatatcgtcccaggtgataaaaccgatcccccctataatgatcaacagcataattaccacatttacaatggcatttccagaatatctcatcagagatggaaatgtattttctgttgttcccagaatatcaaatccagcattacaaaaagcagaaactgaatggaaaactgccatccagactccctttaatccataatccgataaaaaaaccggtaacaataacatggctcctattgtttcaatcagaatggttccctttaagatgaatcttgtcagtctgacgattcctccaactttaggtgctgaaattgcatcctgtattgtacttctttgcataagagatattctttttcctgaaagaagagaaaccgctgccgccacggttactactcccaatcctcctatttgtataagcacaagaataaccgtctgaccaaacacagaccaatagcttcctgtatcctttactacaagccctgtaacacatactgccgaagtggccgtaaaaagtgcctcagaaaatggcgttggcacattctccaaagtagaaatcggaaacatcaaaaggatagtgccaaaaaggatcacacctgcaaagcccagaataatcaattgaaaagaggtcagatgcttcttacgtattatctttgacataactaattataactccttactaataattctaatgctatatcttcgtaatatattttattatatggtgttccgaagttatggaaattgcatagcaatggaacaatccggttatatctgtaagtgccaaaatttccttttgacactcacatcattatatatgattactttcaaagatagtataaaagtctatgattctgtattaagatagtataaagattttatttttaaatatgttctaattattctgccaacattctgaaagataatattatagccgcatgatttaacaaaaaatcatgtggctttatcggagaaagtattgcattgaataatgtggtgtctatttactttgtaagcttcctgttatcaaacgccagcctcatctgatgccattcaacatttccgtgtgtagatttttccgacacaccctcatccaaaaagccaaatttggcatagtatgaaaccagcttttctttacaagtcagcacaagacccttacgtccctgctgctttgcgtcatgaattgcacgacgaatcagttctcccgcatatccgtttctacgataatccggcaaagtattaactccaaaaatcatctgccatgctccgttttcgttgtgcatctctgcttttgcatacatttcatccgtcaagtcctcttcatctgtcacaaaaccatccacaaatgcaatcagtttttcagcttcatacatcagccagaaatgatttccataatatctgattctttcaataaattcttcttctgttgcagcttccgcaggtggaaaacactctgcctcaacttcggcaactgccgtgatatcttctgctgttgcatattttatattcataatttttttcctttatcaaacaatttttaacatctgaatcagcaaaatccatgcaagtccataataagtcacaaccgctaccaggtcatttaccgttgtaatcagcggaccggaagccactgccgggtctacttttattttatgaaaaaggattggcactaatgttccaaccagacttgaaataataattgctactaaaagtgagattccaacacatcctgaaatcaaaaaagcactttcaaatgaatatcctttaaataaagcaatatagattcccaaacagacaagtgccataattccaagcaatgctccattacaaaatccaactttcatttctttaaataataaatgaagtttatctttaccacttaaattttcatccatcaatactcgaatagtaacagcaagggactgagttccaacatttccggccatatcaagaattaaagactgaaagcagattacaacaggcaggactgcaacaacaccttcaaacgctcctacaactgtagaaactcccattccaagaaacagcaggataaccagccatggcagacgctttttcatactctcttttgttgtttcatttaagtcctcttctgctgacaaaccggcaagttttgcatagtcttcacccatttcatcatcaacagcttctacaacgtcctgtgcggtgatgatacctataatttttttatttttacttaaaacaggcaaagaatcttccgcatagtcctttattttttcaatactatcggaaattttttcccggtccaataaataaggatatgcataactgattaaactgtctaactcttcattttctcttgcaataatcaggtcttttaagtcaatcgcaccacaaaagcatcctttctcatcaacgacataaattgttgtaatgttatcattttctccagcctgccgaatcagttcatgcattgcctgacgaatcgtaagattctgtcggatgcaaatataattcgttgtaatcagacttccaatctcatcttcgtcataagagttaatcaaccgaatatccgtcttggtttcatcatcaatcatcggacgaagcttaaccttaacgctttcatcgatatcttcccataaatcaactgcatcatctgcatccatttcattaataatttctgccagtttatcaatgccaatctcttcaatgtattctgacggattatcaatatacgcaatgatttctgccatccattttgcatcgagtgcactatataaaagatttcgctctgctctgtttaaaaactcaaaactttgagcaatatcattttcatgataatctctaagctgttccctcatttcttctatggaaggggatactttaataatttcagcaatttctttcgcaaaaatcggttcttttaatacttcttttctcataataagcctcctctcaccctaaaaaagggcataaaaaatccatcgtaacaacttctgttacacaatcctaagatttataagttgtgaattcgttcctaacgatggattaagacttattatttatattcaatgggataaaatggcgtacttatagacacttgaaataaaatccaagtctatatccatcattatatgtacttcgacttcgactctcacaactgaccatacgactatccgcctccttttaattaaacttaaataattttttttgcgtagtgattataacacccttatttgtttggttcaagccctatttggaaactttacaaagatttatctaaatatagagccaaaaaccttataacttttttataagttatctactgtattaataacttcttctgtcttttcccattctttgataatatgcttttttatcaaaatacattctctggtccgccagaataatctgctcatcaattgaacagacttcttctgacaatgcagctccataggatatattaagtttttcaacctgtttgccatgccattttgcaactgccttttcaaaattttcattcaaaacaaataatttctcaaccgtttcttctaatattactacaaactcatctccacctgtccgatagcattttccatactttccatacacactccgaattgtagatgccgctcctcttaacagctcatctcctgatgcgtgcccaagcttatcattgacttcttttaatccatttacatcaaatatcgcaacaacaatcattttttcactcgacgcttcttttctgattctgtccagactttcctcataagcccgacgattataaagccctgtcagctcatctttgtaagcagaattaaacaaacctctgtcccgctttgcaataatatgaagactgattccaaccagcaataagcaaagaaaaaatactactacatttgctaaaatcaaaacataattattgacataagcataagtatctaaattgtgaataaccatataccagtcaaattttttcatatatttcgtaatggtataatttttactttccggatctttctcatacacataatcatcatggtcgtcttctttgattatcttctctggaagtttctgtaaaaatgaagcatatttctttgcatctccgcttcctacctgaatgtttccctgcgcatctgtaaataaaatatcgataccatactgcttttcatactttgcaatctgcttctgaatttcctccaattccatactgacaccacagactcccagaagatttccctctttatcttcaatcctcacatcaatataaatcagccacaggtccggatattcttcatctccccctaacattaccgtatactttttaccagaatctacgaatttctgataccatacatcatcctcatcattttccacatccataatcttataaaaaccatcataagtataataggctttcgttttttcagacgctacaaatacagttctataagagaaatttttcatatatgaagtcgtatactcatccatttctctgcttatttcctcagcatccatcttttcttcgttttccaacaattcaatcaaaaaatgatccgaagccagtgtattcgccacaataaccggctctaacaaccgactgttgatatcattataaattcccgccgcaatgatttcaccattcttcaatgcatgtttttgcaatacctgatacaaagataccgtcgaaataacggtactgctaacaaaacataaaacaataaccataagcatcaggagaaaaaacctgttctttttcataaaattcttcctcatattcttcccgctaaaacattacaaatattatttttattcgttttagtgagcatagtataattattttagcacactaaagagcctttgtcgaataaaaatataatgtaaaattattcaattatttgcatttttatatatttttgtataaactttcacaaaaaatgattgcataaactgcttcaactatgctataataacacaacatttaagaactattttaccaaacagcggagtaattttacttgtccgcttaactaataaaaacagaaaaataagggtgtgcctgaatttcagaagactgccaaaaaagacgcatgaaagtgcgtttcttttggcagtcttttttattttagcaaattttatttaattcaggcagaaaggagtttttcatgcttgtaatgattgataattatgattcttttgtttataatcttgcagcctactttgaggaattaaatcaggatatcaaagtcatccgaaatgacaaactgacgattgaagagttagaatccattgaaaacctggacggcatcattatctcgccgggaccgggtcgtccacaggatggcggagtctctttagatatcgtccgccattttgccggaaaacttccaatcctgggtgtatgccttggacatcagattatcggacatgcctttggcgcagtcgtaaaaagaggaaccgttccaatgcacggaaaagtaacaccgattcataccacccaaagcagaatgttttccaaccttccggaaacttatgaggtaacacgctatcattctttggtggtggacgagagttcccttcctgatgaacttcaaattgatgcaaaaaccgaggatggtgcaattatggcactttctcataagacctatccggtttatggaatccagttccatccggaagccgttttaaccaaatacggacatgaacttttaaacaattttattacaatctgtaagaaatggaggactcacgattggcagtcagattttgcaaactaaaacaatactgcccgacggcagatttattttccctttatcataccagagaaaccgcttttttagattcttctcttaccaataaatatggaaattattcgattatcggactttattcatacttaaaagcggaagaaaccgatggcatcttaaaagtaaacggaacaattcaaaaagaaagtttgttagatttcttaaatcaatatttaaaagaacacaaagaagaaaatccaaccaatttaccgatgcttggcggagctattggctatctctcttatgattacggcaggagttttgaacagattccaagccggcataaaaaaaagatttcaatgccggatgccatgtttgagttttttgatttatatctcatcgaagatttaaagaaaaaagaactgtatctttctacaagtgagcactttcatacacttgaggaatacaggagcgaaatcatgcaggatattttaacacttgcctctaaaaacgtcactgtagactctcgtctttgcgatgttagaatcaaatccgattttgtaaaacaggattatcttaatgccattgattccatgattgattatattagggcaggtgatatctatattgcaaatatgacccggcagatttctgtcgagagttcccgtaccccttatgaggtttttcgctatttaagggagcacaatccttctccatttggaagttattttaaccagccggagtttcagattgtcagtgcttctccagaacgcttcttggaagttcacgaccataaggtggaaacccgtccaattaaaggaacgagaaaacgcggaatcactcctgaagaagatttgatgttaaaagaagaactggcacaatctgaaaaagataaaagcgagcttttaatgattgtagatttggaaagaaatgatttaaaccgtgtctgcagacccggaagtgtaaaggtgactgaattatttgaagtcgaaacttatgcaacggtctttcatctggtttctacaattatcggagaactcgaaacagataaaaccgtaccggatttaattgcctctacttttcccggcggttcgattaccggtgctccgaaaatccgcgccatggaaatcattgatgaattagagcacagccaacgcggactctacaccggctctatcggatatctttctttaaatggagactgtgatttaaatattgtcatccgtactgctgtgcatcaaaatggcatttatcatcttggagttggcggtggaattaccgctgaatccgaattggaatttgaatatgacgaaacctggcagaaagccaaagccgttgtcgcagccatcgcaggaggtgacgtgcatgagtaatcttactcttacatcattaactccagatgatggttactggtttgggcttggagtatttgaaacaatatgggtgaaacaaaacactgccgtatttttagacgaacacttaaaccgtttaaaaaaatccgctctttttcttggatttctgccggataaaacatctgccagtcaatggatttcgattcggaaacaggaaattctggactatttaaaagaaaatccgacggaaaacggtgtgttaaaattaacactttcagataaaaatctttctctgacttcaagaaaaaatacttataccaaagaacagtatgaaaaaggctttgctttagactacagcaagattttaagaaacgagacttctccgtttacttatatgaagaccttaaactatgccgacaacattttagaaaaacgtctggcaaaacagcgaggatacgacgaacccattttcttaaataccaaaggcgaactgtcagagggtgcaacaaccaatctgttttttgtatcaggtaaaaaactttttacccctgcgctttcctgtggtctacttgacggtattttaagacagtatctattaaaaaactatcaagttgaagaatgtatcatcaaaccggaacaggtttctgactttgacgaaatgtttgtcaccaattccctgcttggaattatgccaatctgccgccttggcgaacacaagtttacccgacgtacgattacaaatcagttaatgcagacttactctgaaatttaaaaaagacgtcgcacttgacaggctatctttccaaatcaaaaatcaagacaaaacaagagcagacgagatttttcctcttctgctcttgtttcatcttatggtcttttcatcatcacatgattcttttctttttttccctgttccattaactgataggcttctttaaatgcctcttcaagcggaaggactccatgcactccaccaattgtaactgaaaatcgaatgtgtggatattcttctaataccatgttattaattgcttctgcaatacgctttaacttcatttcaaacatctggcttgaaatgttttccataagaagcagaaatttatcaccttcatagcgaatcaacacatcggaacaacggatacagttttctatcattttcgcgatatgataaattacaatattacctgctgcatgcccatatttctcattgataattccaaaattatctccatcaattagtgccagtgcattcatctgagtcatatttttagcatattcatcataatatctgcggttatacactccggttaaaacatctctataaaatttctgattatagtttttaattccctcaataaaatcattgcgtccaagcgggtctgaaatcatttcatcccgcattttataaatcatctcaagcacgtaaggatagccttctatttcgatgtatttcgcaatcgtctcataaatgttttcgccgataaattcaattttgctgcactgatcttttttaacagttgcctttcttgatacacaatttttgcagatttcttttttcccaaatatattataacatttatcggatttataaaccgatttcttttctcttaccggaataacttcgtacgattccacatcaatcagacgtacactatcaaatactttttctaattgctgaaccatttcttttaattctgcttttgttccttttgtgacatctttattgttgtcaaaataaatcgtatctttctcatgaatatctataattcttccaagtacaccgatatatttgggttcttcttctcttgaccacaaagactttgcgattacctgacaccatctctgtccttctggataatttgcaaggaatttcatccgaatctcagaatttaccggtgtcgtctgatgcagagctttcgtcaaagtcttgatattctcactgcctaaaaatgtttcttccccttgctccggtttaataatcacttcgcgcaatctcaacagttttgctccgtattcagaaagcgtaaccgcttcaatggcagaatcatattcaaactgaatttcttccagtcctgctgtgaaaaatttgcgtttttcctgctctttttccaaacgccaggagctgtaacttgccttttccacaattctgctgtccaaaagttcttcggttacttttgttaccaaagaaggattgacatccatctgcgcgtctatatccagactgacctcaataatatcctcaatgtcttttaagcattccaataacaatggattaaatgcaccacactgtccatctaaaatcatttccatcgctttttcttttgaaaatgctttcttatagcatcgttcacttgtcaatgcatcataaacatccgccagtgccactacctgtgcagaaatcggaatttcttctccctttaatccatccggatagccttttccatcataacgttcatggtgccatctgcagatttcataagccacactgaccagtgttttcttttgatacgttggaagttcttttaaaatggaagcccctaacatggaatgagttttcatgatttcaaattcttcttttgtcagctttccaggcttatttaaaatcttctcatctatcataatttttccgatatcatgaagcgcagaagcggtactgataatcaagacatcttcatctgtaagattataagaattcgttttattcatcagacactgaagcaataaacgagtcatggtctgtacgtgatgtacatgaggtccgctttcaccatttcgaaactctacgatatgccccagtatattaatcatcatactgttatttttttctttttcataaatctgctcttccaccatatttaacagacgtttctgtttttcataaagcattaaagtattggtaattcggcgatgaataatataactctcataaggtcgtttaatataatctgttgcaccaagttcatacgctttttccatataggaggtatcattttctgcggaaatcataataaccggtatggtatcaatccaatgcttctgattcatcactttgagtacttcaaatccatccatacccggcattacaatatcaagtaaaaccaaatcaatactggtttcatatttttgaatgacagaaagtgcttctattccatctgatgcttcaagaatctcataattctcacccagcattgcagctaacatcacacgattcagttctgaatcatctacaattaaaattgttgttgtttttcgtttttctactctatccatttactattccttcacgaatctttctctgttttcatattcaatctgacaaccacaagacttggcgcatgagttttatcgcctgaaatgaattccctttttatattttttgcaatttttgtctcgcaattattcattttcgcaagaaactcttttttctttacttttataacaaaaaacaggcagaatcgcttctgcactgcctatgtcctctagtatgatattattctatagtagattttgccagaaatcaacctctttttttgcatgttttgacaaaagactttaaaaaaaaggcagtttcctgccttttttcgtattacctttatttcacttttactttttcggttcttttgctgtaatataatatggaagtgcaacaaagattgctccgcctatcatatttccaagcgtaaccagtcctacattgtagatatatcctccaatgctgacggatgcatcacccgcattcatcaaaccaactgccagtacactcatgtttgcaatactatgttcgaatccacaaatcataaatacgaagatacaccagaaaatcataatcagttttgcagcttcagattttaatttaaatccacaccaaactgcaagacagaccagaatattacagaaaattcctctgaaaatcaactcctgtggagccaaatgcatctttgtttctgcaatctttgcatagtatgcaccaacatcaccactcggtactcctgaaatttgaaatcctactgcggaaattaaagaaccaagtaagtttccaatatagcagacaatccatactttaatggtttctccccatgaaacagaaccgccaagtgaagagcctgccataaccagattatttccggtaaacagttccgctcctgccataacaataaggcttaaggctgctgcaaaggaaaacgactgcgcacctcttaccattgcaggagcaccattgattgtcagatttgcgccccaggtaaaggtgataaatccaccgaatgcaataaataaacctgccattaaagcggaaacaaaatatcccactttatttttctctaaaaaatcagcttttgcctttccggcattacataacgttgcaaattcattcttaaacatatacgttccctctcttttcctctaatgtactctcagaatctcaataaagaccacgaaagtgcatcatatacatgttttgatacagaacacttttcctgtttgcataaaatcctacagactcacactccggattgctacctctgtgttctcacagcaaacgtacatgcctgcttttttgcaggtatcattgtgatgtcaagcggatattcgcaatccgcttcgttacttactcatatcggttaaattcaggtacggcataagccgcacctgaacctgttattttagttgaaaagaccctcacttatataaatgataagtactccacaaacttatttatgtattgaatctattaacttagaacagaccagaaatctttcctgtttcatctacatcgattctttcagcagccggtacttttggaagtcctggcatggtcatgatttcacctgtcagagctacgataaagcctgcacctgcggaaatcttcaggttacgaacagttacttcaaagtctgtcggtgcgcccagttttgtctggtcatctgttaagctgtactgagtcttagcaacacaaatcggacagttgccaaatcccattgcttcaagctgtgcagcctgtttctgagcatttgcagtcagaacaactctcttaccaccataaattttctgaacgatgttattcagtttatcttcgatgcttccctctaattcataagagaactggaagtcatttggctcttcaaccagacggattacttcttttgctaatgcaagaccgccttctccgccttttgcccatacttcagacagagcaacgttaacaccgagttctttacatttctgttctactaagtcaagttctgcttttgtatcagttgggaatgcattaatagcaactacacatggcagtttgtatacattcttgatattacttacatgttttaacaggtttggaagacctttttcaagagcttctaagttttcgttatttaagtcagcttttgcaactccgccattgtatttcagtgcacgtactgttgcaacgataacaactgcgcttggatgtaaatcagccatacgacatttgatatccaggaatttttcagcaccaaggtcagcaccgaatccagcttctgtaattgcataatcacctaattttaatgccatctttgtagcaattacggagttacatccatgagcgatgtttgcgaatggtccaccatgaacgatagccggtacatgttccagagtttgaacaaggtttggttttaaggcatcttttaacagtgcacacatagcgccttctgcatgtaaatcatgtgcagtaaccggtttctgctcagaaactttaccgtaagtgtaaccaatgataattcttcccagtctttcttttaagtctgtgatgtctcttgcaagacagagaacagccatgatttcagatgcaactgtgatatcgtatccatcttctcttggcataccgtttgtctttccgcccagaccatcaactacaaaacgaagctggcggtcattcatatccacacatcttctccatgtgatttttctaggatcgatgtttaatgcattgccctgatagatatggttatcaatcattgctgctaataagttgtttgctgcaccaattgcatggaagtcacctgtaaaatgcagattgatatcttccatcggaactacctgtgcatatccaccgcctgcggctccaccttttacaccaaataccggtccaagagatggctcacgaagtgcaaccatgacatttttgccaagtttctgcataccatctgcaagacctactgttgtagttgtcttaccttcacctgccggtgtcgggttaatcgctgtaaccagaattaattttccgtttggtttgtcagattctttcagtaaattgtagtcaatttttgctttgtacttaccgtactgctccagatatttctcttcaatccctgctttttctgcaatcgcggtaattggctccattgtgcactcctgtgcaatttcgatatcagtcttaaatcccatactaaaaaacctccttaaactaaatagagaaaagctgtccctctttttctgcttcgagtttgtttctattaaaattcacgaataatatgccgaatttttttatcagatcacacttcatgtgtaaaaaagggcaacatttgtggtctacaaatgctgcccagacggtcggcccatacttcgttttaatttcactgtggttttccacactgacccgtcagaaatcaaaactgcttttcaattgatatctataatctaccataaaccttatagtttgtcaatgctctaacaaactaaattgtgtattttttttgttttttcagattaaatcggcgcattatttattttgttgaaataaatgtttcgacatcttcttttgttggcattacacgaagtgcgccttttttggttgtaattaaagatgacgctccatttgcaaattccagcatttcatagagttgttcttccgataaaccggtaattccattctctaacacatagtttaaagcacaagctccaaaggtatcacctgctcctgttgtctcgattgtattttcctgaagaaacggcgcatgaaagacttcttttccctcatgaaatgcaatacttccttcttttcccattgtcacattcatcagtttcagattcggataatcagcaagcagtttatatgcaccttctttgatatcttttgttccggtcataaattccagttcttcttcagaaatctttaacaaatcacactgtcccagtccataggcaatctgttctttcgcaagctccatgctgctccataatggtggtcttaaattcgggtcaaaagaaatcaacattccggcctcttttgcaatagttatcgctttttgggttgcttttctgacttcttcatgtgtcatagacaatgttccaaaatgaaatgcctttgcagattccagatattctttctctacctgagattcacttaacatcatgtctgctcctggattacgatagaatgcaaaatctctgtcaccgtcttcaaatgtatgtacaaaagccagagttgtgtgaacttcctgattttcgtacagatgactggtatcaattttcaattcatttaatgtttttctaagagaagtaccaaactgatcttttccaactacacccagaaatgaagttttctttccaaggttatttaacatcgccagtacgttacaaggtgctccgcctggatttgcttcaaaaatcggatttccctgagcactgactccattttcggtaaaatcaatcaacaactcgccaagtgcaattacatcaaactttttttccatgtcgtttcctcactttattttttattgtttcactttgttatttcatacctgttggggctgttttttgccccaatcaatgttgatactcttattatatcggtattggttttagactgcaatcactaactatatctattacaaaatatctacataagatacattcagaaactactcttaatctttccattattcttccgttgtacgagcccatcttacaaagtcccgaaacagattcctaatgttctttaacattccgtcaaaaactcctgctttataaaaattaatcacaatcgcacctatcggcactgcaagtatcattcccaatacactgctgattttatatccggtatacataaaaatcaatgtcaccagcggattcattcctatcgaatctcccaccatcttcggctcaataattctgcggacaagctgtgtcaccagatataaaatgacaagtcccaccgcaaaactggtatcaccggaaagtgctttaaaaatcgcccatggaatcaatgcagttccagttccaaaaaacggcagcatatctaaaaaggaaaccagaaaagaaatcaaaattgcaaattttactcttaaaatcagcattcctataaacaaaatcagccatatgactcccataattttaaactgtgccttaaaatatccactaaacacctttttgaaactctcagcgagcatccgccatttatcctgtatcattttcggagtgtgttttcgtccaaattccagaattcgatttctgtcagcaatgaaaaaatacgacgacaacaacgtaaaaatggtagaaatcaatgcatttggtaaattttttgcaatatttcctgcataatctacggtaagttcgcttaccgtactgattatcgtaccaatttcctttcccaattcttcctgcgtattatcgatactcacctgcacattatccggaagttctttgatgatgcttcttaaattatgctctacttcctgaaattcttcgctgaagccgctatacaaattcggagcctgctccagaaattttccggtttctgtcattacctttgcacctatgagataacttccgccaatgattgcccccaaaaccataataataatcaccatggaggtatgtttccttgatatctttaattttttttccaaaaattccaccagaggacttgctatcattgcaagaatccacccaataataaacggaagaaaaaatttaaacatttttattcctaaaataatacagagaattcccgtaatcagtcctaaaattgctaaaaaaactccctttaaatgttttttcaatgtttttttcataaattaattttccttcatttgataagatttttttaaatttcttttaaaaattcaaatggctctccatcatgaagaaaatgcatcagcatataggacgtcatgatggccaccttttcttcttttaaaatccgttttacttcttctttatctgcaagcacaatctccagttcttctgaatcttccagtccggctcttgacacagttccggatgcatatccataaaccgttgcacaggattcatcggtcattccgattgtcgtaaaatacggtttttcataagccggatttaccgttaccggttctaatgtcaatccggtttcttctttcatctctctgattcctgctgttttaaaatcctctcctgtctctaccagtcctgccggaaattcatagatataatcatcaattgcataacggtattgtctgactaaaacaactttattcttatcctctttacagactgcatagataattactccatccggatggttttctcttgtattcaactttaaatgtctctcatcttttgctcttgatgctacataataatgacctgcttttcctgttttactttctacatccagatgatacaaacgaacatatggattttctgtcatcggagttacttttttaatggatggcatacttttttacccctttctgatgcaattgtgcaatttctgcttttgtaaatagaaagattatagcgcgtttacacttgtttttcaagacatagccgacgatctaaacaacaaaaaagatatctttcgtttttatccgaaagatatctcttttgttcatctatttattctttttaatttataagacagaaattatctctgaacacgtgctcctgcaccgcccatgattgcttctacttcttttttgcttgccattgttgtatctcctggtgttgtcatggcaagtgcaccgtgagctgctccgtagtttacagccagttctgcattctctgttgtcataagaccatagatcagaccggatgcaaaggagtctccgccacctacacggtccataatttcaagacctttgtagtctttggatttgtagatttcaccatcagcccagcaaattgctgcccagtcatttacagttgcagtcttaacagtacgaagagtagttgctactgctttaaagtttggatatgtttttgcagcttcgttaatcattttcttgtatccgtcaaggttcagttcttttaagttttcgtcgtttccttcgatttcgaaaccaaggcaagctgtgaagtcttcttcgttaccaatcataacgtctacatatttagcgatttctttatttacttcctgagcctttgcctgtccaccgattgcactccacatagatggacggtagtttaagtcgtaagatacgattgttccgtattttttagcagctttgattgcagctaaaacagtttcacaggattgttcagataaagcagcgtagataccgcctgtgtgtaaccaacgtgctccgagttccccgaagatgtaatcgaaatcaaaatcttccggtgttgctttagaaatagctgtatttgcacggtctgagcatccaactgctccacggataccaaatcctctttctgtgaagtttaatccgtttctgcagattcttccgattccatctgttttcatccatttaattaaggaagtatctactccaccctgattgatgaagtcttccattaacataccaacttcgttatcagcgaatgctgtgatgatacctgtattcattttaaagcatttgctcagtccacgggcaacattatattctccgccgccttcccatgcacggaagcttcttgctgtacggattcttccttcgcccggatcaagacgaagcattacttcacccagagatacttcatcaaatttacactcacttgctggtcttaaatttaaattcatgattaatcctccaaatttttatgtattgtcttacaattttgctcttatcatttcactcttacaattttgctcttgcaatttcttattatagcatgtggtttttatttttgttgttttttctttcgtgctttccaactttttaaaattctaagtaagcacctttcatcgggcttgctgcatgttcactgaacagacgaagcacaccatttttgtattttacttcttttggtttccagtttttcttacgttctgcaagcactttatcgatttcttccggagttttttcttcccctgcgataccgatgatatttaatttacgtgcaaatacatcaatttcaattaagtcaccttcttctactaatgcaatcggaccgccttcggctgcttccggactgcagtgtccgattacaggaccggtagatgcaccggaaaaacgtccgtctgtaatcagtgcaatactttttccaagttctttatcactgctgatcgcctctgaagtatagaacatttccggcataccgcttccttttggtccttcatagcggataaatacagcgtcacctttgtttactttatgttttaaaaccgcatcaagacattcttcttcgctgtcaaatggttttgcacgaagtacggcacgatacatttctttcgggcatgcagtgtgtttgataactgcgccttccggtgcaagatttccacgtaagactgcgatacttccgtctgttccaattgctttgtcataaggacggataacatcttcttttgtcacattgcagccataacgtttgttaaattcctgcatccatttgtcgcatctttcgtagaatccgtttttctttaattcttccagattttctccaagtgtttttcctgttacagtcataacatcaagatgtaagtgctgtttgatttcttccataatagccggaactccgcctgcatagtagaaacattctgccggccagcgtcctgccggacgtacatctaagagatatcttgcatttctgtgcagtctgtcgaaggtatcacctgtaatttcaattccgagttcgtgtgcgattgccggaatatgaagcagacaatttgtacttcctgaaattgctgcatgaactaagattgcattttcaaagctgtccattgtcacgatgtcgcttggacgcatgttgtccatttttgcaagtgcaactgcctgacgacctgcctgtcttgcaaaatcaagtaagtcaggactggttgccggcattaaagcagtacccggaagtgcaagtccaagtgcttctgccataatctgcatcgtagatgcagtaccgatgaaagaacatgctccacagcttgggcatgcattgtgttttgcccagtttaatttatcttcatcaatttctccgcgctggaattttgcactatacatacctaactgttccagagtcagcatgtccggtcctgcattcattgttccacctggcactacgatagccggaatatttaaacggcacagccccattaagtttgccggcattcctttatcacagcttgcaagaaatacgcctgcatcagatacagttgcatttccgtggatttcaatcatatttgtaatcatttcacgacttgcaagagagaagttaattccgtctgttccctgactttctccatcacagatatcggtacaataatatcttgctccaaatccgcctgcttctgcaacaccctttcttacttcttctactaagacatttaaatgtccgcttcccggatggctgtctccgtaagtactttcgattaaaatctgaggtttggataaatcctccggtttccatcctgtaccaatacgcagtgggtcaagctctggtgctaatgtacgcatttcctggctttttaaacaactcatgttttttgttcctccttaaattttaaattcttagtttctacttattttattttttatttttactttatggacttttctattactatttattaactatttaactaaatatcctccgtcaaccggaatgactgctccacacagataatcacttgcatgggaagctaagaaaatggctgttccctgcatatcctctccggttccccagcgtcctgccggaattctttcgctgatagttttaaaacgtggatttttcgggtcaagaagtgcttcattcatttctgttgccatatatcccggtgcaattgcattgacattaattcctcttcctgcccagtcattcgataactctttggtaagctgtgctactccgccttttgcagctgcataggccggaatggtctgtcctccaaagaaagagttcatggaagcgacattaataatctttccatagcctttcttcagcataatttttcctgcttcctgacacagtacaaaaatagaacttaagttgacgctgattacatcatcccattcatttaatggaaactcttctgcgctatgacgtctctgaattccatgtgaagtaacaagtacatctaagtctccaccaagtttttcgacgcattcattgaaaatgcggtaaacttcttctcgtttggaaaggtcaccctttatgcctacacagtcataacccttgttacattcttcttccgctacagcaaacaccttgtctgatgttccaacaattgccactttgcatccggcttgcaaaaagccctctgccattccaagacccagtcctcttgttccacctgttacaataactttctttccagaaacatcaaataaattctgtcccattggttttttccacctttctcctggtttttaagtcgtcatacgtcgtatctgtttttatggtatcacactccaatttcacggtcaagttcttcttttgatttcgttttatttcagcagattttataaaaaggcagaaggaaatttgtaagtatttcctcctgccttttttatatcttcttagaatttatgtcttctcagaatctttcttattccatctttttcattaataatttaatttgaatcctgttattttccaaatgacgcttcattgcttcacttgctccctctgggtcatgccttttaattgcttccagcacttcacggtgagtcacaattgttttatttgcaatcgaataatctgtcacatcaataaacagagaaattccactttggattacaggcattagattggttgtcacctgatttccggtcgcccttgcaatctccgcatgaaataagatatctttttccagataaggctttccctgattgaaaagttcctctacttcttttgcatactcttcaatcttctctacctgttctcttgttgcacgcagtgctgccagagccgcaatctccggttcaatcatcatacgcacttcacaaatatccagggcaagactcttcttatcctccataaatgcaaatccaagagggtcatccatcagccccggtgtctcacttacgaaggttccacgacctctttttatttccacaacatttcttgataccagtatttttactgcctcacgaatggttccacgtccgacattcaactgctctgccatttcaaattcatttggaagtttttctccggcttttaatttccggtctgaaatcagttggacaatctgttctgaaactttttccggcagaagtttattgtttgaatcgattgatttcagctttctgccctcagctttttttcccatactccacctcaatctttcctttttcttatttttcggatgttcctgatgcagagccgctcattgatgtttgatttttttctgctttctaatttaatatccgaacttcttctcagatattatagtataccagtaatttcctgtaatttcaataaatttgcaattttcgctttctgttcttctgttgcacaaagcagaggctgggcgcagaccggattaaactctactccggtctgtaccattgcttctttgataatcggaataaactgttctccgattgaataaatttccatcaaagaatcaatcttctgctgacactctgccatctttacaagattatcttctcttgctgcatttgcaaatgcggaagcaatctgcggtacaaaatttgaaattccggctacacagccatttccgccacttaatacattatgtgcgaaaaattcatcaaatccggaatatacctggaaatccgggaattcttttttcacaacctgaataatctctcttgtgtgacccattgttccaacagtatctttaattcccacgatatttttatgttttcttactaattcaagaattaactgcgggcttaaatcataaccggtacggtccgggaagttgtataataagaccggaccatttacattgtctgccacctggtcataaaagttaataacagaatcatgtggaagattaaagtaatatggtgaaattaccataactgcatctgcacctttttcgattgcatagtttgacaattcaatacaatcttttaaaatcatgcagtttgttcccacatataaagtcacacgtttgttgatgtaagaaactgcggtgtcaatcagttttttcttttcttccatagaaatggcgaagaactcaccgatacttccaaggatgaggattccatccataccaccctgaattaaatgttcataaattcttttgtttgcttctaaatctacatgtccctcagcgtcaaaagctgttacaacaggggtaatccattttgcgttcatatctcttctcctttaattctagtatcctgcaccttccattgcggaacgagctgattctgtatatctcttaaacaaaccttttcttggcggtcttggaacgattccatttttactgcgctcttttaagactgcgtctacttcttctttggaaagttcttttccattaattccaaccacatccaaagtacgttccggaatattataagaaataatatctccggtttcaataaatgccaacggtccgccacttgcagcttccggtgatacatgtccgattgccgcacctcttgttgcaccggagaatcttccatctgttacaagagaaacttttccatttaatttggtatcgcacacaattgcctctgtagtcatcagcatttccggcataccactccctcttggtccttcataacggacaacaattacatctcccggttcaatttttccatcaacaactgcctgataagcatcttcttcacgattatacacttttgcggttcctttgtgaatccgcatatctttttcacaggcagagtattttacaacggaaccttccggtgctaaattcccacgcagaattgcaatcgaacctttttctgttgccttttcgaccgggaaaatgacttcatctctggttaatccatagttgcttaaataaccaagatttctctcaaagaaattatctttttctaaatcttcgagattttcacccagtgtttttccggttacggtcattacatccagatgtaacatgtcttttaagtatttctgtaccatcggaattccacctgcaaaccagaaagattccgtcatctgagttccgcttgggaagatatttccgatatgcggcactttatgattgatttcatcaaagagctctggtgtcagttcaattccaagttctcttgcgattgccggcagatgtaaagttgcattggtagaaccaccgattgcactatgtacgatgattgcattttcaaatgcttctttggttaaaatcttagacggtgtaattcctttttctaccagttccataattttacgtcctgccagacgggcataagaaagaatgtctcgcatggtagccggaatgactgcggttcccggaagcgccattccaagtgcctctgccacacattgcatggtgcttgctgttccaagaaaagcacaggcaccgcaggatggacatcctgtcattttataatcacggacttcctgctctgtgattgcctcttttcgtttctgacgaagagaaatatctccagcaacaagagaagttgtcatatttggacctggacgcatactgcctcctggaataaaaatagtcggaatatccagacgggcagccgcttttaaatgtgccggtatggatttatcacaggaagaagataaaatcattccatcccatggatacacacttccgtgtacttctaccatgtcacagattgcctctctggatgccagaatatagttcatgccatcatgtccttgtgcacatccatcacagatatctgttgtatgatactgtgccggatatccacctttttcaaacacgccatattttgcctgttccataagacccgccagatgagtacttcctggatggctgtctccaaacacatcttcgagcataatctgtggtttcttaatgtcttcttcatcccagcctgaacccatctgcagggcatcaaactgtgcccataacagacgctgtggtgcacttttttgttgcatttttttatcctcctgaatttttttctttttatcttatcatacaaaattttaaagttgaaatccactttaattgaaaccaattttccgcaatatgtgaacggttaagttttttatttcttatggctttcttataacaaaattcatacaaaatgtaaactaaaacaaaaagggcaaagaacccttttcgattctttgcccagtttcatatctcactttagttcgatttgaatttttgatttaacttacatcaatcctggtaagaatccctggaagagagaaaggattgatacaaaaatcagaattgcaacaccggctacgaaaccaccgatactccatcctctgattgtatccggtacggagattccgaagaaacggctgattgcccagaatccggagtcgtttggcatggaaagaccaataccaccggcacagatagcaatcgcacacagaatcggagatactccggatgtagcaattgtaccagccatgatagctgctgttgttgtaagggctacagttgtagaaccctgtgcacaacgaataatctggcagattacgaagcacagtaccagaatcggaatactgaatccggaaagtgttcctgcgatataatctgcaatacctgttgcctgaagaattttaccaaaagcaccgccggcacctgtgataagaagaatcagaccaacctggtcagcaccttctgacataattgttgtgatagattttgtcagatattttctggaaactaatgcggcatataaaacaccgactaacatagcaaagtttttattaccaatgaaggaaacaaacggtatttcttttcctgctgctaacggaacgaaacttccaagaagaatcaggataatcggtactaacagaatagacagggcttttaacgctcccattctttcttttcctgttgtatctcccatagatgcagcttcttcatctaaatcatcaaatgtatagaaatgtttgtttttctggtcctgtttgttgatgaatccaccataaacaataccacctacaatcatacctacaaatgcagatactaatgcgtagaagaagaaaataccaatttcaattccaagttcctctgcaactgcaagtggtggtgcagtcggcagtaccagtgcgaatgtacatgttgtagctactgaaattgcacatgcgaaagtaaccatggaaatttttgttttcttgcataatactttcagcatcggagcaaacatgatataaactacatctccgaataccggaatacctgtgataaatcctgaaatagcaactgcgattggagattttttatcgccaaaagcttttaagactttatttgcgatagactcaataccgccagcctcatacatgaatttacctaacataacaccaagaccggtaaccataccgattccaccaagtgtacctccaaatccgtctgtaacggtctgggcaatctcaccaagtggcatgttcgcaaccacacctgtaatgtagccagtgagcagtaatgctacgaaagcgtttacctgaaatttgataatgagtaacagcagaattgcaattgcaaggataaagattgcaaccaatgccggacctgttacgattcctcctgaaaacataccgttttcctccctttttcttttttcaatgcaccctcagagcacatcttatttggttttcatgtgacgtgtgacgtcgtatccattccatgagtagactgtaccagattttatacaaatagtcaatagggcattgtacattctgtgagttttagataattttaaagtttattttttggtaaattttcacataacttttttgtatgttttttcttcatttttatttatctcttttttttaaaattaaatgccgaaatactccggatagtgttccagaatattctggaaattttttctgtaaatcccaagatgtctgtcatagaattttttcaggtcaaagtcctctgtgtagccgattaacagctgatgaaaaattttttcatgttctttctgaattgcttccaaatccgttttactcataattgcatcgagataacgaacacggtcataatgggaactgactcttctgactgctctccagacattacttttatttcctgcctgataaattaactgatgaaatttattgtctaatttaaaaaacgcatcaatactgtcttcatttttttcttccagtacttttttctgcaaatccagattttcttttattttttccacgtaatcctgacttaacgaacctgcaagcgttgcaagaatttccggttctaagaccgaacgcataaaatagccttcttttaacgtattaatgttaatataagaaactttagaaccgctctgtggatacacttctaccaacatctcttcttttaacataatgactgcttcatgtaccggtgtccgactcacatgaaaaatttctgcaagctctgcctcatttaacgtttctcccggaagcaactgcatggtcataatattatctcgaagcactcgataggcatactctctattgttttctttttttcttcgttcgctgattcttaacttcatatttttagttttccccttttctcgtcttttactaatatattagtttagttctttttcttttttactctgcttttattttactatccctctgcctgtcacgtcaatttttttcgagcattttcccctgtatttccttgtatttttcacgtttttgtatattttttacagtttttcattttaattcttggcaaaatttatagttgcatcttcggttctgttctgatatattaatggcagatgcaactgatatatcagttttcatccattatcagaagatgtatccattccttttctcttctggtttctgatattcagattgcaaagagaaccagtaaaaagcaaaaagtaaaagtgctccactttccggagcaaaaggagataaaatcatgaaagcaattaaagtaatcgaaccattcaaagtagaaatcgttgacgtaccaaacccaactatcaaaaaagacgatgatgttatcgtaagaatcacttccggcggtatctgtggttctgatatcggaatctggaacggaacaaactctttagctacttatcctcgtctgattggtcatgaatttggcggtatcgttacagaagttggttctgctgttacttctgtaaaacctggtgacaaagttgcagttgacccggttgtaagctgtggacactgctatgcatgccgtatcggaagacacaatgtctgctccacacttgaagttatgggtgttcacagagacggtggtttcgctgaatttgttgttgctgatgagaaaaacattcataaattccataaagactttgacgaatctttactcggtctggttgaaccatttacaatcggtgtagaaatcaacaaccgtggacagattacaaaaggcgataaagtcctgattatgggttctggcccaatcggtatcgctgcaatgcaggttgcaaaaagaaacggtgcagaagttatcatgactgaccttgtaaaagaacgtctggaaaaagcaaaatctatgggagctgatgaaactgtattagtttctgaagataacttagaacagcgtctgttagacttcacagatggagaaggtattccggttgttgttgatactgtatgtattccttcttcctttgaacaggctgtacagcttgcatgccctgccggacgtatcgtctgcatcggtctgaaaaaccagccatcttctatcacaatggctgatatcacaaagaaagaactgactatcgtaggttctcgtctgaataacaactgcttcgatgaagttatcgcaggatttgaagatggaactctgcatccagaacagttaatgacaaaagcttacaactacaaagacgttatggacgcattaaatatgattaaagaacatccacaggatgtattaaaacttgttttaaaatttgaagattaattaattttgctactcccccttaaagtgatatgtgctctcggaagctttctgtaaaaactccgagagtacattaataaaacaaaaccctcttatgattctggtgcaccatgaaagtggtgcaccatttaagactaagccaaaattttagtaacccaataataaactataaaaaaagcgaaaggatttttgattatgaaagaaatttatatcaccaacaaagaatccggaatttccatggacgaaatctccaaagcaatggacaaacttctctctcagtatccaaatctcaaaaaagtattgattatcccgcctgattttacccgctgttactcttacgccggcgaaatttcacagattttatataaaaaacttgctccagaagcagaagttcatgtaatgccggcacttggaactcacatggaaatggacgaagaagaaaaacaaaaaatgtttgcaggcgtgattccgaatgaagcatttttagtacatcactggcagaaagataccatttctatcggtacggttccaaaagaagtcattgaagaaatctctgaaggcttatactctactgatatcgaagtggaagtcaatgaaaaactgattcacggcggatatgatttaatcctctctgttggacaggtggttcctcatgaagtagttggtatggcaaactacagcaagaatcttttcgttggagtcggcggacgccagatgattaacaaatcccacatgttaagtgccatctgtggtatggaaaaagctctcggtgttgcagattcaccggcacgaaaagtatttgactatgcacagcagcatttccttgacggaaaacttccgctggtttatattcagactgttacaactttaaatgatgatgatttgaaattaaacggtttatacgttggttcttccagaaaaccatttgaaaaagcagtggaactttccacagaattaaacattgtccatgtagaacgcagagcgaaaaaattagtgacttaccttgacccggatgaattaaagacaacatgggttggaaataaaggaatttaccgtaccagaatggcagttgcagatggtggagacttaattattcttgctcctggtgtaaaagccttcggtgaaaatgaagaaatggataagatgactcgtaaatacggttataaaggacgtgactacgtgcttgatttatttaacaaaggtgcatttgacaataagattatgtctgctgcacacttaattcagggttcttccgacggacgtttcactattacttactgcaccaaaccggaaaatctctccaaagaagaaatcaacagtgttggctacgaatggatggattacaatgaagcagcttctttatacaatccagacaccttaaaagaaggctggaatactcttgaaaatggagaagaaatttacttcgtaaaaactccggcacttggactttggaaagtagattgatttttattctaatttaaaactcccccatattttctctcttgagaatatgggggagtttttagtttatcttattaaatttcaaataagaattaagcctgaggacctgcagaaacaagtgctttaccagcttcgtttccttcgtatttagcaaagttcttaacgaatctgccagcaagatcttttgcttttgtttcccattcggaagcatctgcataagtgtcacgtgggtcaagaattcctgtatcaacacctttaagttctgttggaacttcaaagtcgaagaatggaattttcttagtcggtacatttaagatatctccgttgaggattgcatcgatgataccacgagtatctttaatggagatacgttttccggtaccgttccatcctgtgttaacgaggtaagcttttgctccgctctgttccattttcttaaccagttcttctgcatattttgtcggatgtaattccaggaatgcctgtccgaagcaagcagagaaggtaggtgttggttctgtgataccacgttctgtaccagctaatttagctgtgaatccagacaggaagtagtactgtgtctgttccggtgtcaggatagatactggaggaagtactccgaaagcatctgctgacaggaagattacgttcttagctgccggtgcagaagataccggacgaacgatgttttcaatgtggttgattggataagatacacgtgtattttctgttacactcttatctgcgaagtcgatttttccatctttgtccagagttacgttctcaagaagagcgtcacgtctgattgcattgtagatgtccggttcagattctttatccaggttgataacttttgcgtagcatccaccttcaaagttaaatactccgttgtcatcccaaccgtgttcgtcatcaccgattaagagacgtttcgggtctgtagacagagttgttttacctgttccagaaaggccaaagaagattgctgtgttttcaccatttaagtctgtatttgcagagcagtgcatggaagcaattccttttaatggcaggaagtagttcatcatagagaacataccttttttcatttctccgccgtaccatgtgtttacgataacctgttctttgcttgtaatattgaacattacagctgtttcagagtttaatcctaattctttgtagttttcaacttttgctttagatgcgttgtaaacgatgaagtctggctcgaatacttccagttcttcagctgttggtttgatgaacatgtttgttacgaaatgtgcctgccaagctacttcaacgatgaaacggatagccatacgagtatctttgtttgcaccgcagaatgcatctactacataaagttttttgttagaaagctctttgatagcgatatcttttacagtatcccaagcttcttttgtagctgggtggttgtcgtttttgtactcatcagaagtccaccatacagtatcttttgagttttcatccataacgataaatttgtctttaggagaacgtcctgtgtaaacacctgtcataacgttgacagcgcccagttcactttcctgacctttatcgaatccttccagttccggttttgtttcttcagcgaataatgtttcgtaagaaggattgtatacgatttctgttgttcctgtaatgccatacttagttaaattgatttctgccatctttacacttactccttttctttcattcctctggaagtgaattttctcacttcccacttagtattatacatgatatctaaataaaatccattaaaatttttataaaattttttattttttctatctttcacaattattcgacgtcagacgtccttttctatggtaaattaatacagttttgctaagataaatcttcttttgctccctttgttttccattttttatgttgttttgatttcctgtacacacaaaaaggatgtcctttactctcccaaataaatgacatccttttttatacccttttttcgatatcaatatccctttttatcccctacaggaggcctcgctttcccgcttccattacagcttctgctttatttgagactcccagcctcttataaatctgctgcgtatggtattttacgttactcaccgacatatttaaccgttctgcgattttctctttagaaagaccatctgcctgaagcttcagaacttccagcattgcatcacttaacgtaacgctctcgattcccgccttcaaatatcccggataatagcgggtcattttttccgtttcttccaaaacctgcttccagaactgccggttctttttttccccttcttttgattctaccctcgaaggttcccatctgctttgcgtaagcaatgggcggattgcagctccctcacgtgtaataatccgcacaaaatgatattcctctgccatttttaatccttcacacagagtctcatcccaccgttcatccccaatacggtactgtacaatcgccatcaataatttcacttcgattttgatataaatgcgtttcattactgttgcatagtactcacattttaaaagcagattgtacgcctgttcatttctcccattttgcagatacacacgtacttttgtcagataatgaaatctgtcataaattgaaaactcctgttcttcatccggtgctttcttcatccatttctcaatctctgcttttttctggctgtagagcgcacatcgtataataaaggtttcaatattcggaagcaggcgttctgcttcttctttttctgcttttttatagaaccgttttaacagttcttctgcctccgatacctttcctgtaataatatgcagccatgccagcatgccgtctgccacaaagcattgttctaattttcctccggtctctgcctgcattctccccttattggctaaggaagcgacctcatagttgtcctcacccttctcaaaaaagctttctgaaagagccagatttaccataccctttccatatttcccaaggataaattcaaccagttttccaatgccttttgccagttctctgtctctcttgctccactcacagaagtcctttccgccattcatctgagatgcctgattactggtgacagaaaattcctggagactgacctgcttatccaagattaacagatgtgcctttttcagaatttctatcatattctcactgcctctgtgcggaagtccgatttccagatacagtaattcacttctcgccctacgccgctcccttccggaatgttcctttgcatactgttccaattcctgataccagtgttcactctcttctatatccaataaaagtgactgaagcatgctcattcccatcataagctccggactggtacggattttttcgtctgaaagcttcaggtaatattttttcagctgataataataaccattatttggtgcagttctcgcattttctatcagcaaagacgcaatccgctctttctcccctgctttttgatacatctcaagcgcacgaattggttctttatttagctgataatacaagcctgcattttcataaagggcatgtatctgctctttattatactttcgtttcagacgtctgcgcatactgatacacatttcccgacgaaattcatacacaacttcgtctttttctgttctttccatcataaagtttccgagccattttaccctgcttaaaattgattctacattatttatccccgtaatcatctctgccagatgtgctgtaaaacaatctacaatcgaaacttccattaaaaattcctgtattcggatatcccagttgtcatagacatgccagtcaagataatcccacatctgggataaccccctgtcaatcagctctgaaaataatttatccgaaaaatactcgccctcttttagtccctcacgaagctgaatctgcttatatatatcccatgtaatataccagccaagcggaacccccaaacagtaatttctacttaccttgcgctgttccggcgtcaacagtatctttgtatattctatgtattgattttcctgagcttcatcaaacaataattcagactcttctatcacataaaagacttcgcggtaacggacagcagcaagccacggtggtacggcacatctccccgataaaatcagccatacatcttcccgttcaatcaacgaaataattgcttctttgatatcttcacattcttcctccattgccaaatcatgcagattatcaattaccacaatctttcgtttttcagattctgcaatcccctccagttcttctgcgcttacccttccagcatcaaacatctgatattttttctgttttaaataacggacaatcagttctgtcttaccaataccgctcactccgtaaatataagcagttatattttcttcttcggcagccttcaaacgcctgagtgcccgttttggccggatataacatattttgtccttttctgtcaatgatacacccctcttcctttttcctttctatacatagaattataacaattttcgacatctttgtatactaaccaaacggctagtattttcaaaaaaacgcagattatttgaacgcagataagcattcccctgcttcaagtgcgcaaagcactaagcagcgggtaaggggggatgcttatgtcagcgggagttgaaaactcccactgacagattgcgaagcaactgcgttcatgagcaagtagcgaagcggattgcgaatgtccgctttacttacatgaagctctgtgttacctgaaatttctgcacggatgtttttgtcaaaaaattttacataaatttttcatttctgcgcctgcatactttacaaatgatttctaaaataacagtaacgaaacagaaaaagaatttttttatttttattcattaatttagaaacgggggatgacacatgtatcagaaattatggaactttacaaaaaaacataccaggaaaacgcacaccgcttttctttttctcttcactcttattaccggatggagcattgtcggacttgttatcggcacacttttatgcctgacaactgctatgagccttccggttcaactcaccgtacttttatgcaccaccggatatgccggactgattcccggattctttgccggaatcttctttctttacaaattgaatctgaaacgtcctgccggattaacgtatcattctaattcagaggagcgcacaataaagctgctataaaagtgaattctttttgttaccgcaaccgtaggataatcccattctccatttttttaactatggtaaaatagatgccccatgcaataaatgccaaaaagagaatcaacaacccctctccagcattgttgattctctttctttcatgcctaaacttaaagcctagaaaaaacgcacattatttatttcactcatctaactcaaaaatcttattatttactagttcatatttgccgccatccatatttttacgaacaaacggcactccttttcttacataaaacacattctcttcaatcaaagcatccggattctcagaaggactaatcgtcccccctaaatcatcaaagctttcatttttacggaaggtattatgaattgcctcctgcaagcagaacatcacgcagccgccttcattttgtctactatagttatactcatagattgtgccatcccctgaatctgcatcatatgccatgccatcctggttcaatctcgtatcagcgacttcgttatagcgaaagagcgcatctttacacttccaaggccagattcctgctgctacctttcctgctttatctcctggattgcaataaatccgatcattcatctcacacgcaatcgaatctgccatattatgctctaccagcggacgcagcgcatacattgctgtaattccgtctcctcctgccgctttcacataattatcgcaaatcttcatattttcatgtccatacttcaagaacgtttcttcgtcaagctctgccccctgaaacttttcatgtgcatacgtgtagcctactgcaatcccccaacggctcacctgatacacaaaacaaccctcaacggtaacatcctgataacgtgccacacccgtagtctcttcacattttggacgaagcgctgtcatgtaaattccaccattattcatgtgtttatcatacacattgccatgcacatcatgaatcagcagattacgcagcgtaattccgtgccgcacccctttatcttttgccacaactgcaaccccggtgcgattcattttgtctccaagtgaatactgctctccgatgatctcgcttgcctcatttgtaatttccaaatcttccacaataatatattctgcatcatacagtaaaactgcggacgatacatatccgtgatacacatgtgtcggtgcatccaacggatttccataatcctgataccagattccctgtccacatgcttcaatccgaggtggttctccatcgccgtataccccaatcacaatcggcgcttctttactgccactatcagtaatatgaaggtactgtccataaaatacgctgccacgctccagcaatacacggtctcccggtttgaggctgctatgattgattgcaaaaagactggcaaatgccgtttcgcaatttaatccgtcgttcgaatcattccccctcttcgaactcacgtaatacgttttcgataagcttgtcatacgcatcctcccgtaaccgtttttcaataatctgtgcaacttcttcatacgtaaagaaatcaccatgatagcgtccgaataaatccatattttgttcgtaaaatgctcgcttttctgcttctgtaaactccggacataagccagttttgcgaactgcctcacttggctgcacaaaatctaatttcaggcgtgtcaactcatactgcagataggccggagctgaaaaataatgcggtccatagaacttcttattctcctgctccagttttttcagcatcctattatgcgcctgtcgccttgcctcgaatccttccatagaaggtgtttccaataatccaagtttgtgtgccaaaaggaaggctccctgcgccttccttaaacactcctgtttgatacaataactctgtcgcattattttaccgctcctgtaattccatttgcaaaactcttctgtaagcataagaagatcactgctgttgggagtgtacaaattaatacgccaagcatcagcataccatagtcaacgctgtaaccactctttaagtttgcaacgagcattggcattgtgattgctttgctatcctgtaaaataacagttggccataagtagttattccatgcactcatgaaagttactgtcatggctgctccataagtagatttcataaccggaataaacattttgaaaaaaatctgaacttcacttaacccttccagtctcgctgcctcgataatatcatgcgggaatgaacgcgccgcctgacgaaacagcataatcatgaatggagtagagattgacggaagtgcaagcgcaatccaggtatttaccaatccccatgaagtaaacattttaaataatggaatcataattgctacgaacggaagcatcatcgcaagcagcaaaatgctcattaaaatatctttgcctttatcatggtagatttcgaagccgtatccggcaatggagcacacaagtaatgctacaaatgtaatgataattgcattacggaatgagttaaacatcgcaagtttcagattctgcatcccaactaaggttttaaagttttctaccagataaccacctggaaccaaacgtcctcttaccacatcaatacttgtattggttgctccacagagcatgtaatacaacggaaatgcagataaaaagcttgcaagaattaagataatgtatgaaattactttttttgtcttagtcacgtttgtcacctactttcatctgaatcgcagacaggattgccaccattataagaataaatacagataatgccgctgcatagttaaatttcggtgtctctacaaaggaaatattgtaaatataatgtgccagtgtcattgttgacttacctggaccaccgcctgtcaagttcatagattcatcaaataactgtaatgttccggatgttgacataattgcagtcataagaatcgttggtttcaaaagcggaaccgtaatctttataaactgcttgaacggagtcgctccatcaatataacttgcttcatatacagagtaatcaatattctgtaaaccggcaagatagaataccatgttgtaaccggtccatctccaaatcaaagcgattatgattacccaacgtgccggccatgtactctggaaccaatccaccggagcaccaccaatagaagtaagcactcgatttacgactccatccggagcaaataaggatttgaaaatcatagaataagataccagtgaagtcgcacatggaaggaaaatcaacgtacggaaaattccttttcctttgatatgtggactatttaaaagctgtgccagtcccaatgctaagacaagcatgatcggaacttgaatgataaaataaaagattgtgttaaataaacattgctgaaatgttttatcctgaaggattctggcatagtttgaaatcccagtaaattccccgtttgtttttctaaaggaaagcaggattgcctgcgccatcggataaaaacaaaatacaaagattaaaagtgctgccggaatgagaaatgcccatcccgtaagattatgccgtttttctaaacctatttttttcatgtttttctcctaaaatagagccgggaacgcaagatgcactcccggcacgtcctatttcactctttaatgattactcattaatattaaattctacagtatcctgagcgtttttaatttcgctgtcgatgtcagcgccattctgaactacatttgtgattgcatctgttaatgcacttctgatgtcagagtagtatgcaccgtaatcgattcccggaacttttcctgcaaaatctacgatatctttatatactgtctgtccaccatagaaatcagaagcttcattgtaaacttcagattcagctgccggtaagtaacttgcgatcgctccggcatttggaagcaggtcgtcatataattctacgctttcgccaaatgttgatttaaggaaatcaaatgcaaggtctgtgtttttacagttagaagatactgcccagcttgccccaccacagtttgcgtaatttgtagcgccttcaataccatctaattttggcatatcaacgattgcccagtttccggactgctcttctgctgcctgaatagaagacatgatccaacatccctgaataacacctgctgcagtacctttgttcatagaagcgatgtactgatcccaatcagtgtaatctaccataactttttcatcgattaactgtttgtaagtttcgatagattttttcagtgcttcgtttccaactaagtccactttaccatctaccattggagaagcgcctgcagactgaagcatttcgattacaatttcagatccgcctgaacttgtaagcatcggaacgttgtttttctcaactacttttttcgctttttcgataaaatcagaccatgttgtatctttgaaatcatctactgtaagaccagctgcctcaaccatatctttacggattgccatgattgtagcaccgttgtcaaatggaacaccgtagttttttccatctactgtagagtctgctaatttaccagcagagaactgtgagaaatcaacacctgaatctgttaactctgtaaagattcccggatagtttgctacgtttttgtggaaggaataatcctgcattaagaaaatgtccggtaatgtgctgtaatcatctgcttctgctgctgtgattaaagcggtttcaatatcagagtatactttttcctgaatatccagtttgaaatccggatgatctttctgatacattttttctgcctgttccattgcatacacgttgaagttcggatcccaacaccatacagtaagtgtctcttcctgtgctgctgcggtatcatctttttttgcttcgctcttgtcttctgcttttccaccacatcctgcaagcacagatgctgccattgttgctactaaaaacattcccaatactttctttttcattgctatgatcctccttagattaaaaatattcttttataaaatatgaaacgctaccccgcattccataagttaaccttactcaacatcatcaacccagcgcatttcacccggttccatatctaatttgtatacacagttgccattgatgtaaacctctgtgtactgtgcttcggatgaattgttaattactgcaatcttcttgctcttctggaatacggttacttcagtatccacatttgttacataataacgtttcatctcattctccatacctgctgcataataaatcgcacgcagaagaattctacagttctgaggagaatatggaagacctgcaaaataaacactatgtccttttccatattcatttacaactaactggctgtattctccgtccattgcaaggacttgataatttttgccctgtgcgtaaactcggcttgttccctcaccaaagtctacttctccatcgatatcttctaagatgaaatgagttgcatccagttcattatacttatctgtattaagtgagaagcacatctcacggtctacaccaagtacatcagataactggaagaatcttccctgatgctggtaagcagtcggttcacccactccgatgaatccgcctccctggtcaacgaatcggcgaatacttgttacaaccgcttcatcaatccagttttcagctccactaaacgcagtatatgcgtctccaacattgataattactttgatgtcttccggaattccgtttttcacatcatcaaaagagataaattctacttcgaatggcattccacttaagcattccaatacgccttctgcggaataagtttctctatgccagattgcatgatgtacctgattagacatccatcttctctggctaccccaacaattgagaattgccaccttaaatggtgctacataagaaggagtttccttcatattttcatgaatttctctaaactctgtaacaaccttctgaatttcatcaataaatcctggccagttacttgcaagttttaaatatccgccgtatccgattcgatccaatggagaacgaagcagcgcacgtctggcttttctccagttatctcttgcttctccgattgggtctccgccttctccaaacacatccgggaagaagtatggtaacagacgaccttctgtataatctacacctttaatatcagaaatcatacgaagggttacaccacttccaacggaacctacgactgcatctaagccgattcctgcaaaatacttgccatacggttctgttccgatccaatgatctccaaggaacatcattgcttcttttccataagaatgtacaatgtcaactaattcttttgccagtgcacacacttcaatctgctggaattcgataaagtcgcggaactgtttactcggcacgcggaacatactgttgtgatatccctgatctacaatgtattccggacggaatttgtagcctgcccatttttcaaatttttctaagatatatgggcttacgcttgcgctatatccaaaccattccacatatttttctctttttttatcatcaaatgtcaatgtgaactgatggaaaaaagttgtaaatcgaacaacgtcaatatgtgggttttcctcacaccatcttttcagtttttcttttacatatttctgagtttttggttgtcttacatcataagtcaactgatgtggtgtatcctgccagtcatttgtaataaagttgtacatatgtaccggatcccaaatcaagaatgccagaaagctgacagtatattcatgatatggtattgtctggatttcaacttctcctgaaacttcatcaaattcccatttatctataggaacaatttctccagttgtgcgatcgattacttcccaccagcgtttcggatcatctaatgtatttacttttaactgttcggtatgaaaaccttccattaaacgaatacgaagtgtctcgcctcttgcggttacacgatcgctaatcaagtactcctgctgaatctcatccggattctgcattgcccactcattatcttttcttgtagtataataagtcgcatatttctttactggttctgacaaaagcgcttccggcatctctgttccgtcgcagtccctcaatgcatctgctcctaaaagattttttagccgtattgtttcgtcaacgatatctgcatcagtcggcagcgtaagtcttcccgtcatcaacactattccctccaaacaacttttttcttatcttttatctgatagctacagtatagcggacttcaaaaacgatatcaattttattgttgctcgttttgttatattttttgctattttatcaataaaatactatttttttatcaattttttatgtataatggatttatagagaatttcattttactattttttcgtcttttttacgaactttatttacctcacgtaacttaacatacaagactcgcacataataattaaaaggatgtttgcttatgagtaatgaatttattaatctcggttccgccaatagccgccctgaagattttaatcttcgttatatttcaatttccaaatatgagggtgactggcactccttgccacatacacatcaattttcagaacttttttatgttctgcgtggcgaaggaatcttttatatagaagataaaaaagtctctatgaaaacagatgatttaatgatcatcaatccctatgtagagcacacggaaaaaacacttccaaataatcccatggaatatattgtgtttggtgtcgaaggtcttgccttctcatttaatgacccagaccaagatggtactcaaggctatagcttctatagctatggttccgacaaaaatcagtttattaacttcgcacaactcatgatgcgggagtttcaggataaaaaatctggatttgaaaaggtctgtcatggattacttcaagtgcttttagtctatattgcgcgaaagcaaaacttgtctgtaatctcagactcttctttccggctttccaaggagtgcgcgcttgctaaacgttatattgatatcaactattcccagaatattacgttagattctttagcagaaattacacatatcaataaattttatctggcacactcatttacagaatgtatcggacaatctccgattaactatttaaccaaccgaagacttgaagcgagcaaagaactgttgacttcttcgaatttgtcggtaacgcaggttgcttccagtgtcggcttttcatctcaatcttatttctcacagaacttccagaagaaggttggcatgtcacccagacaatatcgtaaactgcactcaaagtaaaaaaatcctaacaagtgcaaggcaaattacgctttgcagcttcgttaggctatttttctgcatttaagaacgatttttttagcttttttagtatactttctctacttttctgttataatgatacctagtgtttgttaattttacttatatttggaggcttttacacatgaaaaagaaaaacgctgtacagacaatatcaattccctcagctcactccaataacacactgattcatcaaacttcaaacgtctccgcgaaaattacattatctgattctattttgtccggagccgttatcgaatatcgcaaagccggttacaactttattcgtcacttacatacgaatattgaaatttatcgaattctttccggcgaatgttatatggatattcagtccgaaacactccacttcacagaaggggactttgtcatgatccttcctgatgtggtacattccttttatctgaacaatacctcagactgtgagttccagcatattcattttgatccggatctattttcaacgattatccttgataatgatgggatttttccgatcacattgcttcatgcggtgttattctcttcccatttttattatcgactgcgttcggatgcgacgattgacgagcagattcaaaaattgattgatctgtatactgcttctgaaagtctgtttaccgcagcaaacgtaaatgttgcactgatgaatttgatgctttacattctcgatcataccgaaccggtgcatgaatacaaagaaccacagctacaaaatagctatgtcgcttatgcactgaattatattcacgatcattatactaccaaaatcttacaagaagacatcgcaatacagttgcaaatttcggtccgctatttaagcaagatttttaaaagctatatgggtgtgactctctcaaactatattaatatttatcgcattaactgttcaattgaactaatgcaaaataccaatttaactttgacagaaattgcgctgcaggttggatttaaagactcgcaacattattcaaaggtctttatgaatgtaattaatgagaccccttcacaatatcgaaaaactgtttcaaaataatatctaatacaaaacaggcaggagcgaatcatcttcactcctgcctactttattttcctttattgctttatcaagcggatattcgcaatccgctttcgctacttgctcataaccaaatagctactacgcagcttatcagaaggggcttgcccccctcctgatacaagcaagtccccacccctgcttattgctttttgcaattgaagcaggggacttccttgatttggttaaatttagtcttcttttttacgttttactacaacagttcctgctgccgctgcagacgctgcaaatgcaagtgcccatgctgttacgttcattgtatctcctgttttcggagaagtgatagagctgcttccttttccagcagagccggaacctgtagttccgctacctgtacttccgccacctgtgcttccgctacctgtacttccaccacctgctgctggttttttgttgtcatctttcttgttgtcgtcttttttattgtcgtcttttttattgtcgtcttttttattgtcatccttcttgtcatccgctgtttcttttactttcagatctttgaaggctttttcgattgctgcttttgcttcgtctacctgctcctgagttacattttcaccgttcagtacgttctgatactgttcgtaaacttcctgcagttttttcagggattcttctgtatatttttctttctcttctaatgctttctttgcatcttctgcagttttattcagtttttccatatctgccatggttataaatgtttcttctacttcttctgtgatctcagactcagtaccctcttcatttactgcagttacagcaacattatacttcgtacctactttaagaccagtcagctcatatcttgtttcttttaccggtgtcgcatttactttttcgccatccagatatacattatatccttctactgctgctcttgcgagaaccggatcccaagtaaccagtgctttcgtatgtttaatttcagagatttttacattagtaggagcggctggtttttccggagccggtttttcactttctaatgtagtaaatgtagttgcttccgatcttgcagattcatttcctgctgcatcgactgcgcttactcttactgtatattcggttgcttctgtaaggtctgtcagtgcaaattcagtacctgctacaagctcctcatttacttttgcttcatttacatatacgttgtatcctgctacacctacattgtcggttgcttcgttccatgtaagcttagctgttgtttcggttacttcggttgcttttacttctgctggtgcagttggtgcttcggtatctgtttcttcttctgcttctaatgtggtaaatgtaacagcttcggatcttgcagattcattttctgctgcgtccactgcggttactcttactgtgtattcggttgcctctgtaagtccggttaagtcatactctgtaacagttaccggagaagcatttacttttgcttcgtttacatatacattgtatcctactacgcctacattatcagtagatgcatcccatgtgacttttgcagttgtctgtgtaatgtcagctgctgctacagctgttggaacacttggtgcttcggtatcttttggttcctcttttttcagtgtagtaaatgtagcagcttcggatcttgcagactcattttctgctgcgtccactgctgttactctcactgcgtattcggttgcctctgtaagctcagttaaagcatattcggtacctgttacaagtgtatcatttacttttgtttcatttaagtatacgttatatccaactacgcctacattatcggttgcttcgctccatgtaacttttgcagttgtttcagttacttcggttgcttttacttctgttggtgcagttggtgcttcggtatctttttctgcttctgttgtaaataccactgcttcggattttgcagattcattttctgcggcatccactgctgttacagttacactgtactctgtagctgcggtaaggtctgttaaactgtattcagtacctgttacaagtgtgtcatttacttttgcttcatttacatatacgttgtatcctgctacccctacattgtcggttgcttcgctccatgtaagcttagcggttgtttcggttacatctgttgcttttacttctgccggaacacttggtgcttcggtatctgctactgctttgtctacatatgtaataatcggtgtgatatgcgcagatggtttgcttgggtttccgctattctttgctacgacacggatcatatcgccttgagctacttcaagctcttccgctttttcccagtctcccactttctctttactatttacaagcgttacactcttcttctctgtgccatttacaaagagacttaaggtaacagttccgtttgcatttccagactgacgaagatatggttcatcatcttttacgttgaatgtaacggttccgctcttcggtactcgatatgccattgcagttacaatgtcggagtttggcggtgtagaaagcagaccgtgtacggctggatttgttgtggtcactgtaccctgtggtgcatcaagacctggaccataataagtgtttactgcccagtttggccatccatcactatcatatgtggtcatatttgcccagtcgccgtcgcctctcttcatctgtccaaaccatacatttccctgctgtcttccaacataatctaatgtccagttgtatgtatttttctgtttcactgtatagtcatttttagttccgtcttctgcagtaatgcgaagtgtcattccctcttctactgcagcgccatcttccagctctgtttctccgtttaatacggaaacagttgcggtatctgctacagtgatattttctttcacttcttttacagtggtcggattgttttctgtgtaaggaacactcaggtttgtacctttcacttcataataacaatctttcagttctttatcagaacttgcaactactgtataagttacatcttccattccttcataagaaagcacgatagtagctccgccttttacgatatcggaatcgccaagtacgttttcaccatttttaatggtaactttaacgcctgcatctacgataacgttgttaaggaaatctgctacggttgtgtttttcggaagatcacttacgtttgttccggaaacagtatacacattggatctcagtacaagtgctgctactgcatcactttctgctgctccgatttccggtactgctgtgattgtatgtccgaagaaatcgtgatcgattgtataaccatttctatcaactactactttaccagcattgattgccggagagttttctgcaagtttgtatccatcaaatacggtctttgcatttggatcttcatgtgttcttgcttttttatttgctgctacagaatccggaccggaacctgcatcaaccagtacttttgtaccttcatttacttttacagcagctgcatcgtttggataagtacttacattgtagtataagttattgctgtaagttttatttccgttgatgttccagttacttactgtagccggtgtttttcctgcaaagtagaagatattattttcaatatctaccggaccaccattaccatgagtatagtgccagattgtattgattccttctttaatatagaatgtgttgttgtaaacctgacagtttccggagtttcctgccgggtctaaaggtcccatatcttcattctggctgatgttataacggaatgtattattgatagattccggaccacagaacataattgtacttgcagtatttccatggctgtagttgtactgatagtttgttccatcgccatagtcagcatcccatggctgtccatcgccatttccttttgatgcattcaatgttgtaaaacattcattatactggaaaatcgcatttttacatttccatggccagatacctgctgccacacgtcctgccccaacattctgttttccgatttcattaccatttgcatccagtcttggctgctgctgtgaataatcagtagtattaatctgctctgaaccattctcagatacattatactgaatcaacggtctgtcaagatacattgttgtgattgcatcaccacctacatgatttaagtagttgttctcaattaccacattagaggacgcatatttgtccatcactgcatcggataatgcacctgttgtgaactgtctccactgataagtgtatcctactgcgattccccaacgatttactgtatccagagaacagtttctaatctggacatcattgtatcttgcgattccggtttctccttcatttgttggctttgcaacgataaaatagataccaccgtttgtcatgtgtttgttataaacgttacctgttacgttgtgaatgtaaagatcatttaatacgatatgatctacggttccattgtcttttgcaactccggcaacaccggttcgatccattgcatatgcatcattatatgctttatctttttcggtatcggttgcactgtttctgtcatttgtcagctcaagtccttcgatttcaaggtattcagcatcttcaatcaaaatactggaagatacagtacctttccatttatgattctggttatccagcggagtaccatagtttaactcccataatccatgaccgtttgtattaatctgtggtctgtctccttctccgtaagtagatacttttaccggagcttctgctgtaccactatcttcttttgtaaatttaagcgcctgatcttcaaatacagagccttttttcagaagaatggtatcccccgggttaaggtcaagctcatttaccttatccaatgtctgaaatgcttcgctttctgaagttcctgcgttgctatcttttcctttttttgaatcaacataatacgttgttcctgatgcagcttctgctccctttgcactaacaggaactgccggcatcattgatgccactgttgttccggcaagtaccagcgccagagtactactcatccatttttttctcatgttgttactccttccatattattctatattcttcaaagtaaaccggctgacttgctccatatctccgtttacttgagaatcattttcaagctgtgcgatcttttcatcatacttttgttcacgcacttccctttcgactgcaattcttgcggtttcgagatccgcattttcctcgctgcctccaaaaatccagtctcgactttcataacattctaaaatctcggcttctgtcagctccatcccctcacgagtgagatcattgcagtattgttccttcaaggtactgacttcataatccaaatatagctggaatgtatattccttgagtccataaattacttcgccttttgcaactttttcgcttcgttctgcgttttcgtccttccaacgctgctccaaagcttcatagctgctgtcggatacatccccgcattcttttgcaagatcatacaccgcatgaatatatttcagctgctctacggtattttccgctaaaatttcataaccgtgtttgtcatcatactctttttcccagaaatcttcttcataaattgcattgtaatcttgttgaatctgcattttggtatcatactctacggatttcatacaatttagatattcctctttaccaatcgaatgttctccaaccgttaaatcgaattgcttgtgattattgtattggacggcacacgtggcaattcctgtgactgcaatcacgaatactgcaattccaaacttttgaaactgcgtttttcgattcttcatagtcttttcttcccttctgcatagggttttatcctgcctcctatacgcagactgtatctgtctaattttgacttcattataacaatctgtttctttttcggctcgtcctttttgattgattccatcgctgattttgtcaaattcggaactagaatgaaatttctttttttgtgttcgggcacaaaaaaaatgagcagaaaaccccaaccgactcgtcggataggattttctgctctatagtagataaaaaacaatatcctcgtcaatgacgaggatatcttctatacgggtatttaatactctgcttaaaataacaaagttatccagagttggcagggaatttcctgagagccatttataaatggcctgtggatattcaaatcccattgcttcttgaatatctttcacagtgtatcccttttctttaagaagtgtcttgatgcgtgtgccggtttctttttgcagaattgacaaatacacaggtttcataattttgcacctccatgaaattcaagtcgaaagccaggcttccgactgagatatgccatcccgaaacattatttcattttatcattttcagcaataaaaatccagcttttctttcttcctattctaaaaattttttaatattttcaaacataatttctatcttatccacctttttttctgtgtgataatgaccgcagtaccatttctgataattaagtctatcctcaattttatccaaccattcctctgttgttctatccaccttgctctggtctaatccttccaaaaagacttccgtcggttcatattttaacggtacggtatggcttaacactacatccacattccagctgagttcattcaatttccgttccacgttctgcttgatttcctcagaaggctgttcatccggccaccagccatacccatgaatcaatcggtacattctatcgacactatatgcaccgcctgttacaatagtctgctttccattaaaatcaaaaacctctccatcctttgcaaaaagcaaatccggatactccttttcataataaaccacaccgccacgccataatttttcctgatagcttcctatcgtctgcggtctttgctcatgatttccatgaatacaaaaaaatgtaattggtagggtttccagaaactctttctttacatggtcttttacccatccaaagaaattaatacctgcgtccccaagaataatcaaaacatcctcacggcttgttttgaatttgccgcaaaactgctcaatccgctcaaacttcccgtgggtatctcctgtgatgtaaatcacgattttccaccttcctttaaattgtaaagcgggggaatgcttatctgcgttcaactacctgccaatttatgaattacttttaccagtaattctgcatcaacaggcttcgcaacatgctcatccattcctgcttcttttgctcttattctgtcctccgtaaaggcatttgctgtcattgcaataatcggtattgtttttgcatcctctctgtccaaagaccggatcagtcttgctgcttcatatccattcttgaccggcatcataatatccataagaatgacattaaattcaccaactctgctttttctgaatcgttcaacagcttcctgcccattccatgctttggtcacgtcagcaccttcatttcgaagcacaaattcagaaatttccatattcagctcattatcttctgccagaagaatatgcagtccccgtatagaagcttctgattttttttcgatttcaactttgccgctcctgtctgtattaatccgaaatggaacccggatcacaaatgtagtccctacacccttttcactttcaaggttaattgttccgcccattttctcaaccagcttctttgaaatcgccattcccaagcctgttccggcaaattttgtacggcttcctgtatgttcctgtgcaaaaggctcaaaaacatatttctgaaattcctcagtcattccgattccggtatccctgcagacaaattccatcgtcggcatttctgtctgctctgatggaatttcccggcagctgagatagatatacccgtttgctctgttatatttcactgcattcgacaggatattcatcatcacccgtttcacatgccccggacttccgataagctctcggtgtatgatttcttttttctcccatacaattcggatattctgttctgcggcaatctgcttgatcacaataagcacttctttggaaatactacttagattgaatggaatttcttccataacgacttctcccgactccagcctactcatatccagaacatcatttaccagttccagcaacagattggatgcctctttaatttttgtcctgtattccgtctgtttctccatatcatctgcataatggtctgccatattaaccacaccgcagattccattgatcggagtccggatatcatggctcatccgctgaagaaactcagtttttgcctcattggcggcttctgccttttttgccgcgctcaatagttctgccttatatttttcatctttttcctgttcctgtttctgatgcgccagattggttcggtatgcccagaaccagaatatactaaatatcagaaaataaagaaaaataacgcttatcacacttaatggaaggttacggaacacttctatatccggaagatacgcatagatataataatccctctgcttcagcatgactccgtagcatccgcttccttctttcctcaaatgataaatgtgctgactgtctgtatgctttttcattgcctgaacaacttcgttgtcggctgtattctgtctcaacagactctcatcattactggcaacaacgattccctcgtctgcaacaagaatcgttccatctttctgagtactatagccatttaaaagaccctgtatcgtcagtgtatagtttctggcaaattccggagatgtgtaatagtagattgccacgatacccggtgcatcttttctggcacaggctgcaatatcgatatgtgacccatcttccctgtcaaaccgttccgaatagcttctttcttcatatccggcaaaatccatgataatgtctttttgcagatactccgtaatctcacctgtcagagactcatccatactgtattcacagtccgtctttccctctgtatccagtacaaggataccatccacccagagagtctgaagatttcctttgaggaactcccggcttagctgaccgccgttttctatttctatgttaatatttgtactcatctgtctggcactttcaatcgcacggagaagacttttggattccgaagattcattataatgagtgtaggtagagcactgcactttgacataatttacaatctccaccattcttttctctgcttccgttttttctgtgtggaagaaataaagcagggaaactacagccacacagattccaatcagaccgccgagcagctggattcgtttttcttttttctttctcttaatatccaagatcatccacctccagatacttttccggatcatccagatatttttcaatgattttcagggatgtgccatcctgacgcatttcttccagtgtctgatccatttgctcacagattcctctgtcatcctcttttgcaaaagcaacacctattccggtgatcatcagaggttcttccaggatacggaagcttgcatcataatccttcatatattgaacgatagattcctcgtgtgctgcaaccgcatctacatatcctttcccaagaaacgtatagatcagctccctatgtcccaggctgatcagatttcccagtttcgggattctttcatctgtccgcttcagaaagataccttccggtttggttgtggactggacagccagattctttccctccaggtcactcagtttatagatatcactgttctcatttacagcgaccacctgacggcttgctatatacggtcctgcccagcgataatcatcaagacgcccttccatggaaaagcagcccatgatacagtcaatttctccactctccaccagttcttttttcttctcccagttgatctggacaacatccacctgatagcccattcttttgaatgcttctgtagccagttctacatctatacccgtcggcacgccatcttcattcagatagttgtatggtggatagttatcgctgccgagggtaataacaggtttttctggttcttctttcgtgttatctgtgtttttacaccctgccagggtaactgctaaaaatcccgcaagcagaatgcctgcaagcactctttttcctttcatttttcgtctatccctaactatccctttcgtttttttcatatctgattctctgccatttgttactattctttgaaatatgggcattcataccaaaacagaagatatctaatctttttaggaataaatatcttttgcttttaagttaatgacattgcttattttcgctctaagcatgcgacagtttctacatgcacgctcgacggaaacatatcacacactgccactttttccaactgataattctcttcacacaaaatttttaaatctcttgcaagtgttgcagaatcacaactgacataaacaatgcgttttggtttcatctggagcatagtagaaagcagtgtctcatcacatccttttcttggtggatctaccacgataacatcggcatacactccgtccttttcgtatttttccggaagcacttcttctgcttttccgacataaaactcagcattttcaattttattgagtgctgcatttttctttgcatcttcaattgcagccggtacaatttccactccatatacctgttttgctttctgtgctaaaaacagggaaattgttccgattccacagtataaatcccaaaccgtttcatttccgtcaagccgggcatattcgagtgcagtctgatacaacttaaccgtctgtaccggattaacctgataaaatgaaagcggagaaatctgatatttgatgtctccaatataatccgtaatcgtttctcttccccataaaggaagaatctcatctcctaagattacatttgtctgttttttattaacattcaaggtaatacttgtcatacctgaaatttttgctaattgtctgcaaagtgcttcggcattcggaattgaagttccattgataatcagacagaccataatctctttcgttgtaaatccataacgaataagtacatgacggataagtccttttcctgtggtttcatcataaggttctactttattttcttccatataagaaatgatttcatttaaagtcatttcattaacttccactccaagcaggcagtttcggtttggaataatcgaatgagtccgtccggcataaaatccggttacaatatttccctctttgtcttttccaaatggaaactgtgctttatttcgatagcgccacgggtcttccatgccgattactttttcaatcgtaaagttatcaaaacctccgattctgcggaggtttgcttctactttatttttcttaaacgcaagctgggcttcataattcataaactgaagctgacagcctccacaggctcttgcctgcggacactttgcttctacgcggtcttttgacggctctaacactttcatcagtcttgcaaatccatagtgtttttttgttttcatgatttttgcttcgactttatctccaatcactgcatctttgataaataaagtgtaaccatctgcttttccgattccggcaccttcatgactcatatcttcaattgtcacctgtaccaaatcatttttcttaaattccattttatttattcctcaccgcactgtgtttttcttaagtttgattcaaagaaacggttgtatccaagccagtctttattgtctcccgctgaacggaagatttctgtaatcgtttccatcttggcatccgtattatctgcaaggtttaaagcagcagcctctgcaagtgccggttttttcggtgaaccatattcaagttcgccatgatgtgccagaatacaatgttttaattcactttctaattttgccggaaatcccggaatttcctttgccatatcgtgaatcatctctgtaccgatcataatatgtccgagtaattgtccgtcatcggtataatcattcatcggaaatgcacttaactccacggtttttccaatatcatgaagcattgctgcggtaatcagcaaatcacgatttaagaccggatatgctttgctgtaatactggcaaagacgcactaccccaagtgtatgctctaacaagccaccgataaatccgtgatgtacagtctttgctgctgaatttcccttaaatgtcttgataaattcttcatcttcctcaaagaatttcacaagcagtttatttaaataagcatttttaatgctgtgcacatatttcagtaattcttcatacattccgtcaatgcttttttcactgattggaagatagtttccaggttcgtattctccctcatgcgcctttcttgcacgtttaatgctgacctgaaggcttccctgaaaagaagtaacatctccgatgacatcaatataatcaagtgtgtcaaagtcatcaattccctgagaattcggttcccagatttttgcatcaattgtgcctgtcttatcctgtaaaattacattttcataaggttttccgtttttggtaactgccggctgtttatgcttacacagataaattcctgagattttttcaccttcacgcagttcattaataaatttcataattctcctaacctctggtcctttattggtcctctttctttttctttttttataatgctccgagtgtcacatcaaatgtaacctctacatatccttctgtcgcctgccgcattgcctttacttttattgtgtcaccgctgttacatgcttttagctgttgctggtattctttcatgctctctattttctcgccatttacttctgttatcacgtccgcattttgaattcctgcctgcattgccggagaatccacttccacactttctacaaaaactcctttgggaattccctttttctcggaaatctgtggtgtaattgtttctcctgtgacccccatatagacaatactctgattgttagataatgtttctattagttcttttatctgagaaatagcaagtcctgtcaccatgtttttagaatctcccaaagcaaaagactgcgcaataacgccaatcagttcgccttcggtatttaacaaaactccacttcccttttcacttccaacaatatcagtagtcagtataccatactctgcatcaattttggaaacagaatttgtcacagaagtcagaattccaaagccaatagaatctttatactccatcggacttccgactgcaattaccggttctccttgttctgcactgtaagaatttccaagtacagctgttccgattttacttcttgtatcagattcaatctctgaatctgatatctttaatatcgtaagcccggtacttgtatctgattttaaaaatcttgcatcaacaaccgtatcgtcacaaaactgtacctgaattcgatctacatttttcacaatcccatactgcgtcagcacataaagttcctgcccgttatccgctacaatcactcccgacatctggctttcataaggagtctgaaaccagtcttcatcacttttaacaccgataaccgttaccatcgcttcttttattttatctgcttttttcagtacttccttatacatttcgctataattatcaatagaaagtccggactgctcaccttcctccgattcgcttatgtcttctgtatcaatacccgcatctgtctgttgttcctcttttttctctgtctcttcgtcagttggaatttctactttctgttccgtcctctttttattttcaactgcctgcgaaatctgcggctctacaactgcaaaaaccagtgcggctgtaagtccaaaaatcgctcctgcccctgcaagaactcctgctgccttccacatttttttcctgtctaatggttttttcttaattgtttcttttataaattcatacgatccgtcttccttattctttttctcgtccatgtagattcctctgcttttttggtttttataaaaaactttttgagaacaccctgtctctcttggatgtcttattcctaatcatttggatgtcttattcctaatcattttactttggcatggcatcattttagcagacacttatgaacaatttatgaataactcttttcatttccccggatttagggtagaatgattaaaaacaattgacaaaataaaggtgatcaaaatatgaatgaaaaagcattaaaaactcttgaatattacaagattatcgatatgctcgaagcttttgccacttcttccattggcaagaataaatgccggcagcttcgccctctcgataatctgacagaaatagaaaccatgcagcaggaaaccgcagacgccctctcccgcatctatcagaaaggcagcctttcttttagcggagtgaaggatgttcgcggttctttaaagcgtcttgaagtcggaagtacccttggaatcggagagcttcttgctatccgttctttactggaaaatgcaagccgtgccaaagcttattccagacaagagacagaaaatgagcatacggattcacttgataacatgtttgagttaatcgaaccactttctcctcttgctaccgaaatcggccgctgcattctctctgaagatgaaatcagtgacgatgccagtaccggacttcgtcaggttcgtcgttccatgaaactgacaaatgataaaattcatacacagcttagttcctttgtaagtggaaattccagaacctatcttcaagatgccgttgtcactatgagaaatggacgctactgtattccggttaaggccgaatacaaaagtcaggttcccggtatgattcatgaccagtcttctaccggttctactatcttcgtagagccaatgacaattgtacgtttaaataacgaaatgcgtgaattagaaattcaggaacaaaaagaaatcgaaatgattctttctaatttaagccagcttgctgccgaaaatcttgacgctatttttgatgacgtcaaacttttatccgaacttgattttatttttgcacgtgcccagcttgcaaaatcccaaaatgcgaccgagcctcgctttaaccgagacagaatcattgacatcaaaaaagcccgtcatccattaattgataaacataaagtagttccgattgatatccgtatcggtgaaaccttcgacctgttaattgtaaccggtccaaacaccggcggtaaaaccgtatcattgaaaaccgtgggacttttaactctaatgggtcagtccggacttcacattccggcatttgataattccagactgagtgtttttcgtgaggtatatgcagacattggagacgaacagagtattgaacagagtcttagtaccttctcctctcacatgaccaacgtagttcgttttatggaaactgctgattccgattctttagtactcttcgacgaacttggtgccggaacagacccgacagagggtgcagcacttgcaattgccatcctttctatgcttcacgagcgtggcatccgtgcgatggcaaccactcattacagtgagttaaaagtctatgcgctttctactccgggtgtggaaaatgcttcctgcgaatttgatgtcgaaactctgcgcccgacttatcgtctgttaattggagttcccggaaagagtaacgcatttgctatctcacaaaagctcggacttccgctttctattattgagcgtgccaaagaacaaatcagtcaggaagatgaaacctttgaagatgttttaagcaatctcgaagaaagccgtaagaccatcgaatccgaacgagaagaacttctttcttataaggaagaaatcaaaaccttaaaagaacaattagaagcaaaacaggataaactagaccagcgaaaagaacgaattattgctgaagcaaatgaagaagcgcaccgtattttacgggaagccaaagattatgctgaccagaccatgcgtatctttaataaggccggcaaagacagcatgtctgcaaaagagctggaaaaacaccgttctgatttaaggaagaaaatggacaaggctggaaagaaagttgccttaaaaacaccacaaaaacaaaaatctacccttcgtccgcaggatttatcgcttggcgattctgtaaaagtcatgagcttaaatgtaaagggaacagtcagttccaaaccagattccaaaggtatgctgtttgtccagatgggtatcttacgttccaaagtccatatctctgacttacagttaatcgacgaaccggttatcacaggacctgcactttctcgtaccggagccggaaaaatcaaaatgaataaatccgcttctgtccgcaccgaaatcaatttgctcggaaagaccgtagacgaagcagtctcagaacttgataaatacttagatgatgcctatcttgcacatttaagcagtgtccgtatcgttcacggtaagggaaccggtgcccttagaaaaggcgtacacaattatctgaaacgtctaaaatatgttcaggatttccaccttgcggagtttggcgaaggtgacgccggtgttacaattgtggaatttaagaaataggggttaaataaatggtttcaaaacagaaaattttaatcgtcgatgacgacaataacattgcagaactgatttcattgtatcttaccaaagaatgttttaatacaatgattgtcaatgacggagaagaggcattaaatgcatttgcctcttttagtccgaatttgattttacttgatttgatgctccctggaattgatggttatcaggtatgccgagaaatccgtcaaaaatccaatgtaccgattatcatgctttctgcaaaaggtgaaatttttgataaagtacttgggctcgagcttggggcagatgactatatgattaagccgtttgattccaaagaacttgttgcaagagtaaaagctgtcctgcgccgttatcagccaacggtcgctcctgccggacagcctgccggaaaatacgtagaatatccagaccttgctatcaatctggcaaattattccgttgtctattttggaaggcagattgatatgcctccaaaggaactcgaacttttgtatttccttgcttcctctcccaatcaggtctttaccagagaacaactcttagaccatatctgggggtatgaatatatcggagatacccgtacagttgacgtgcatatcaaacgtttaagagaaaaaatcaaagaccatccatcctggtctatcagcactgtatggggaatcggttataaattcgaggttaaaaatacatgagaaaatctctctatataaaatttgtaatttcctacctgattcttgctttcattggattttttgcagtctccatgtttggttcctctatggtacacaatcatctggactctgtttacagcacttccttatatcaggaagccacaaatattgcccaaaaccaggcttctaaatattatagggaacaggcttccctggaaagtgtagcgcaaaatctggaaacattgtcaaaatatcagaatgtggaaatctggctgattagcaaaaaaggagaaattcttttaaatactgcatcggattcggatgataataaacttactgtcatcgaagattttaatcccggtcattcaaatggaacttactaccagaccggaactttctttaacatgttctctaccgaacatttaagcgtaatggttccagtcacttcccagttaaatatacaaggatatgttgccatccatctgccggaaagtgtgattttgaaccagcagaatcagattatgaatatcatttattctttaattttaattattcttctgattatgctctgtatcctgcttgttttctcttttatggtctatcaaccgcttcgcaagattattgccggtgcggatgcctttgcttccggaaacttaaaatacaacattccggttcatacaaatgacgaaatgggaacacttgctgtcaccttaaattatatgtcagacgaacttgataaagtcaacgaatatcagagaaaatttgtcgccaatgtctcacatgattttcgttctccgctgacttcgattaaaggctataccgaagcgattttagacggcacaattccggtggaaattcaggataaatacttaaacatcgtagtctatgagacagaccggctttataaactgaccgaaagccttttaaccttaaatgacattgatgaaaaaggacgtatgcttgacttttgcgattttgatatcaatgcagttgtcaaaagtactgctgccacttttgaaggaacgtgtcgaaaaaaacgaatttctattgaactggtcttaaccggacagaccctttacgtgaatgccgatatgggtaaaatccagcaggtactttataatttgattgacaatgcaatcaaattcagctctgctgaatctacgattaaaatcgagacttctttaaaacatgagacgatattcgtttccgtaaaagacagtggatgtggaatcccaaaagacagcttaaataaaatctgggatcgtttttataagattgattcttcccgtggaaaagaccgaaaaggtacaggacttggactttcgattgtaaaagaaatcattcgctctcacaatcagcatattaatgtaatcagtacggagggcgtcggcacagagtttatcttcacactcgcccgaacagaagagggaaacagaccggcttaatataccggcactgtttccctcttttttatttccaatcgtattttgtcaggtgtccttctaagcgcatatggtcaaaattgttctgacgcagtgcttcatagagtacaattgccacagaattacttagatttaaagaacggatatctccaatcattggaatacgaattgctgtttcctggttttccagcaaaatttcttccggaattccaccgctttcttttccaaacataatatagcagtcctcttcataatgcacatcaacataagtctgaggtccttttgtagttgccatataaattttcgcacctggatttttctttaagaaatcttcgtaattaatataagttgtaacatccaaatctttccagtagtccattccggcacgtttaattgctttttcatttaatttaaatccaagtggttcaatcaaatgaagtctcgttcctgttgccacacaggttcttccgatattccctgtatttgccggaatttccggctcaaacaggacaatatttaattttgccatttttcttttctcctttaagactaataaatcttctattcgtatattactgataaattttatataattcatcactctgaggcttatccatgtatctggtctcttccccatttcttaaaattcgttcgtttttatcagtcgcttttccgattacagaagcttcaatacctgcctgatttaattttcttaccagaccatatccatcatctgttgcaatcatcatagaaccgctggacattaagatataaggatttaagccaagcaattcgcacacttcaaccgtttcctgacgaatcggaatcttctttaaatcaatatcaagaccaacattcgaaccacttcccatttcccagagtgcgccaaagacaccaccttctgtaatatcatgcatggcagatacgccccattcttttgcgatttttgcttccggcacaacagaaagatactggtcaaagtgttttgctgtctccacaaaagatggcgcaaagcgttctaacaactctgcttctttttcttttgcggcaatggatgttccctcaaggccaatccatttggtaatcacgatatcctgtcccggtttcacggacgaagttaccaacacttcttcctttttaattgttccaacaccggtcacagagattaacggatgttttactacatcagtaatctcggtatgtccacccattacttccatatttaactgactgcaggcagattccactccacgcatcatctcttttaattcttcttccctggtttccggtgtcagaagcatggtaagcataattccaatcggttctgcaccggaagccgccaaatcatttgcagtgatgtgtacgctgtggcttccgatatcttttactgttccggtaatcggatctgtggaaaaaactaaaacgtctccctcttttggctcaaaaactgcacagtcctgtccaactgccggtccgactaatatttcttctcttctgtgttttacttcttttaaaacggaacgaatcaacataggttccggtaattttcctattttcatcacagttactcccgtattctcttctctatttttttcttataccagataaaccagtgctgccggaataatcatcgccagcgccagaataactgccagtacacctgctacaaccctttttttcttacctgtcattttcatcataatttcattcactccattattcttccataagacgacaaaattttgtcaattaaccttgatgcttcactttttgtaagcgcatctgtttctacattagaatctattctatgatattttatcaaatcctgcaagtatcgtttttgtcttggagttgccggactttgttttttcgctttatagacaagttgatacggtttaaacacatctggatttgacgcttcatattcctgtatgaatctctgataaagtttatgtgtcaccagggcatcttcaaaggcacgatgcgcatgttcctgctcaatctgatagtgcatacgcagagcctgaagccccttttcaggcagttccggcactaaaactcttgcaatcttaagcgtgtcaattccctgatgttcaaactcaagtcctgaatttaccgcccattgttttacaaaactgaaatcaaagataatattatgaccaagcagaggaaatccctcgcaaaattcaaccaattctccaacaacctcaccaattaccggcattccctttaccatcttctgagaaatcccggtcagtgccgtaatccgctccggaatcttcatctgtgggtcaattaatgtggcaattcttccggtttctcttccttcttctatcttgactgcaccgatttctaaaatccggtcgttttttggtgacagaccggttgtctccaaatcgagtgccacatagttttccattttttatctcctctatctttgaattttctacattttgggttactccagctctttcttttacttcttacaattcatctcttatacttataattgaacaaaaaccgcttttgcatcattcgtcagcggacttctctttttataatcgaataagaccggataagcacctttttcttcgttttcatttatgacatcataagtaaacacttcaatgtgcgtcatttttatcgtctgtcttgcctgatagctctgataatcggttaacagttttggattttcctcttcttttttataaaaatccagaatctgcatcttataagctgacaaatcatttgcccactgcggtcttgttttcatattttctcttgcgtataagtcaaaaatcataagctgtttaaaatattccagatttgcttctttttcctgtaaaaattcctgtaaaatttcataacgacggattctggtatgagaaacctcgttataaccgtttttctcataaaaatctgccagttcttcatacatcgaaaaggccgtttcaaataagtattccatagcacggatggttttctggaactgaccgctattatagtaaacttccaccatttcctcaacgccttttagctttaaaatctcttcataagagagccagcgtgttccaagcacttcataaggtggttttgccttatgcacgcagccatatccttccgctgcctctgccatataagaaccttttaagacttttaaaaatccaagctgaagctgttccggttttaacgcatagacatcattaaaggaatgtccaaaactctcataattttcataaggaagtcctgcaatcaagtccagatgctgatgtacattctctcctttttgtaccgcttttacttttcttgtgatttcttcaaaatcagtctttcgatggatttctgcaagggtcttttcattcgtggactgcacaccgatttcaagctgaatcaatcctggccgcatcgtctgaatcagagcaatttcatcctcggttaataaatctgctgctacctcaaaatgaaaattcgtaattccgttatcatgctctttgatataagtccagattgccatcgcatgacttttcttacagttaaaggtacggtccacgaattttacctgcggtactttgtgcgcaaggaaaaattccagttctttttccaccagagaaaaactgcggaatcttaactttttgtcaattgaagagagacagtaactgcaggaaaacggacagccccgactgctctcataataaataattttatgttcaaaatcttttaaatcttcataaggaaaaactaaatcatccatattcatgatatctctaagcggtgtctgatggatcgttttgttttcctgatacacgattccattgattccatctaaggattctccctgactttttccgatttcataatagtttattaattctgtcagtgttttctctccctcggcgcacataattccatccacttccggatgtcgttttaaaaatttgggtgcgtcataagacacttccggtccgcccgcccaaatcgtaacctccggcaggatttttttgatgtcctctataatctcttctgcataagaaagattccagatatagcaggaaaaacaaagcaagtccggctttgcctcatagattccttttaaaatctggtctttttgctggttaattgtaaattccaataactccggttcatatccaaaggttcttgcataagaacgcagactgtaaaccgccagattggaatgaatatattttgcattaattgcaactaatactgttttcataagtttctgttcctctttttatttttcaatcgatacaatgttgattatacacatcctattttattttttaaagaccaaaaaagaaaaagacagctttcactgcctttttctcatacaataaaaaatatttattttttctttaattttttaacaaatcgagtttcatctgccggagaatgatctgccataacttttgtatactcattttccacgtaatctgctttttcatttccttttgaagcaaaagtcatctttaagaagattggtgaaatgatggttgtaataacaaccacgataacaaccggtccaagtaaggaagatggcatcagaccaactgcatttccttttgaggcaacaattaaagcaacctcacctcgggaaatcatacctgcaccgattcttaagcagtcctgtgtggaataatgacataattttgcccccagtccacatccgattacctttgtcagtactgcaacaaccaccaatgctactgcaaagatgataatcattgcgctcatatccggaagttcgacctgaataccgatacttgcaaaaaataccggagataacaatatataagaaagaatattaaatcttcttgcaatatagtttgtatgagtcgtgtttgtaataatcagtcctgcgaaaaatgcacctgtgatatctgcaactccgaagaactgctctgcacagtaagaaaacaaaagacaaattacaaatgatacaataacaaaacgctgtaaatctcttttgtatccctgcacccatttctggaaaactgcgtggatgatatatcctccaaccccaacaaatacaaagaaacctatgatttttacaaataccattgccacattgacactcgggtctgcaaggcttgtaattactgtcaaagcaataataccaagaatatcatcgataactgctgctccaaggattgcatttcctgcttttgtgttcaattttcccatctcttttaaagtttcaacggaaatactaacactggttgctgttaaaataacaccaatgaaaaagttctggagtgttgtacttgcagtcgctgtggattcaatcatacctgggcggttaaaaatccatgcaattccatatccgccaacaagaggtattaatacacccataagtgcaatgataaaggatgcctttcctgttctttttaactcaccgatatcggtttcaagtccggcacaaaacatcagcacgataacaccgatttcagaaacctgatgaataaattctgtctcttttaagataccaaggcaggctggacccaaaatcagtccggcaagcagtgcaccaactacttgcggcatctttacccttctggtgagaagcccgagcaattttgtgctgattagaatcaatgccaagtcaagtaaatacgtgtaagaatccatgttttccatctcctctgttatttttttgtattttaaaaaaacaaaaatcgagttaatggtaacacactttatctgaaaacgtaatatacaatatcaccaaaaaaatcgcggcttttacagcagtttttccattctaattgagaatgccgctacattgatttacgttctgcaatctccgccattttggcagcatttaaacgggtatctccatggacacggctataggaaagataaccgttcatacggtcaatcttggtcagattcttagagccgcataccgggcaaacatccatttcaagttcctcatgtccacaatcatcacagtatgccagggaaagattgactccttcgtaatatcccaaatccattgctcttctgactaaagagcgaattgcctcaacattgtatccaatcggataacgtacatactggatttttccaccattacacagttcccagaaacgaccttcgcagtcctgtttttcaattggagtgatatcttctgttacatggcagtggaagctgttactgacataaggtctgtcagaaactccttctacaattccatacattttgcggaactgctctacctgtaatccacacagactttctgccggtgttccgtaaattgcatagagataaccgtcttcttctttgaattgatttaccttatcattgatatactgcagtacttcaagtgcaaattttccatcttcacgaatggattttccattgtataattcctgaagctcatttaatgcagtaattccaaaggatgctgtcattggctttaataatggtttgattttatcggatggttttaaatgtccgccataaaatcctccctcacagtaagccaacggatttgtagacgctttcatttcacccagataatcgtaagtacgaatgtgaagctgtcgaatcatttccagataaaaatcaagcacctcatagaaatcacggttctctgcacgtgcttttgccagaatcatcggaagatgaagactgactgcaccaatgttaaatcgtcctacaaataccggagcatccttctcgtctgccggtttcattccgcctcgttcataccatggacttaaaaatgcacggcatcccatcgggctaatgacttttttataacgtttatacatacttgaaatgtaaccttttccggtaagggaaagccagtccggatacatcgtctttgcagaacaggaaattcctgcctcaaatacatcttctccctcttttcccggtccatgaagctcttcatcgtataagaacacaattttcgggaataaaaccggtttcttatggtctttctttccctgtccgtctttatgtacttcaagcagggaaatacttgccattttttcaaaacgccccattccaagtccaagagtcaccgttacaaatggatagtcgcctcttgatgagccgactgtgtttagtttatattcaattccctgccagccctgatcaaaatcacgacgcaccttatcggctgcatactgttttgcacgttcttctgcaagctcccagtccgggtctacatattttaaaaattcttctttgtacttatgataactcttttctgcataaggagctaagattttgtccacttccggaacagtaaatccaccgtattgctgggctgcggtacttaaaataatatctcccattacatcaaatgctgtatcgagtgtcttcggctcattgtaccacacatttcccatctcaaaaccgccacgcagtacatttgccacatcaaaaaggcagcagttcatggtatccagacgagcggactggtcatgaatataaatataaccatctttacatgcctgcagttcattgcggttcatgaaaaatttacgatacagctctttattcaactcattaaaaatcagacttctcttggttgcaaccagcgcactgtctgtatttgcattgctcttatctccaatataacgaatggactggctcttggtataaacttcatccatcatatgaataaaatcatgtttgtaatttcggtaatcacggtaacttttggcaaccgccggattcactttttcaagtgctccttctactacattatgcatatcctgtatggaaatttccggttttcccatgccttctactttttctgttgcataccggcagataaaatcaatctcctcttctgtaaactgataaagaatccttcctgccgatttatttaccgctcttacaatcttctgcacgttaaattcttcttttgtcccgtctttttttataatacacaccatttcttccacctctatcgccacactatatctggtatgacattttatttctttcgttatttttatcccatatttggtattagccagtatagcacattttaccggtcatgaaaagagggaaacttgcacaaatcttgacgatttatatcaagtatccccttaaacatcttgttttacacgatattgaccaatttgataaaaatttttctttttatttttttctcagcttttctcttacgcttcaatgactccgtcaaatacaacagttgccggacctgtcatataaacaagattttcttttctgtcccagaaaattttcaaatcaccaccaagcagttttacggttacttcgtcgttcgtataaccatttaatacacacgcaacagcaaccgcacacgctccggttccgcatgccagtgtttctccgcttccacgttcccatacacgcatctctaccgtattttcatcaatgacatgtacaaactcggtatttacgccttccggaaatgccggatgcttttcaaagtacggtccgattttttcaatctccagtttctcaatttcgtccatatagaccaccgcatgtggattacccatagatactgcggttacttcataaacatcgtcatttacgccaagaggctgactgataaccttttcttttttataaatcatcggaatctttgcagcttctaattccggctgacccatatttacttttaccagacttacttttccattttctacggtcagttccaaatacttaattccgctcttggtatctacgctgatgctggttttatcagtcaaaccgtaatcatacacatactttgccacgcagcggattccatttccgcacattgcaccctgacttccatctgcattgtacatttccatctcaaagtctgctttttcggatggtttaatcaaaatcagaccgtctgaaccaattccaaaatggcggtcactcacttttattgacagctcagaaggattttctacgttctcttccagacagtttacatatacataatcatttccaattccatgcatcttcgtaaatctcataattttcaagcctctctttctaatgattacatcaatcatagcaagccttgatttttttgtcaatgtggcagaattgccgaaaaaaaattttgaaaaaaatactttatttaatgaaaaaaagctccaccttggaaacccaaggcagagccctttcaaattggaaaagtatgaggagttacttttccagatggcaatctttttttatgcagacatcttatacgaactgtgctgctacgattgctgcaatcattaacggaatgttaaagtgcaggaatgtaggtacgcaagtatcccagatgtggtcatgctgaccatctgcattcagacctgatgtaggtccgagtgttgtatcagaagccggtgaaccagcatcaccaagagctgctgctgcagacatcaggatgatagttgctgccggtgagaatcccatcttatgacacagcggaacgtaaagtactgcaagtacaggaactgtaccgaaagaagtaccgattcccattgttactaaaagaccgattaatgtgatgatagttgctgcaacccatgtatttccattcataaggctgattgcactgtcaaccagttcttctacagcacctgtgctgtttaagactttcgcaaatccacctgctataagcattacgaatgcgatgaagcccattaatttgataccgccgttaaactgttcatcaatatctttaatttttacagctccgaatatgaacataactaaaagtccaccgaatgctgctacaggaagagaaccaaatttaacctgaagaattacgattacgagtgctgctaaaagtgtaatccaatgtttgtattctaatttcaggctttctaattcatgctgtccctctaatttgatatcctgatattcacgaggttttctgtatgtaatgaatacggcaattgcaagaccgataatcatagcaactgcaagaatccagtttactcttgtaacatcaccaattgttattttccatccaaagtctactgcattctggttgatgttgtctcggatgattgtcataaaaatcagaccaaatccgaatggaagagcgatatacggtgctttgtgaccaaatgcgatggtacatgcaacaccacgtctgtccagtttcatcttgttcatcatactcagtaatggtggaacaagaatcgggatgtatgcaatgtgaatcggaatgatattctgagatgcacatgcaatgattaataagattcccagtaaaagccatctgttaccctttacagtttttgcaattttaacagataagatttctgtaatgccggtgtatgccatacaagaagcaaatgtaccaagcaatacgtatgctaaggctgtttctgcgttagaactgaatccgtcgataacgcagctcataatactcacttcatctccggagctgacaaccggcaaacccccgataagaccggctacagtcagagatacgagcatggagagtaatacattaattttcagcagacacaatacacaaagtaagagtactgctacgattacaggatttagcatagaattacctccctcttttcgtaatatttagtttttttattttgtctctaatgaaccactgattgcctcctcaactgctttaatcagtgcatcattcttaataatttcttcacagtaattaatatcaccgtataattctctatcctggtctaaggtagcaacttctttacgaactaagtcatacgctgcctgtgtacctttaccaagacctttgttaccacgcatatcgataccctggcaggctaccataagttccatagcgagtacacgtcttacatgttctgcaattgttccagcttttcttgctgcaatcatacccatagatacgtggtcttcctgacctgctgaagatggaatactatctacagatgccggatgagccagaactttgttttcagatactaatgctgctgctgagtactgaacaatcataaatcctgagcaaactccaccgtgtggtgttaagaatgccggcagatcgctgtacgctgggttaaccagacgttcaatacgtctttcagaaatatttgctaattcagatgtagcgattcctaagaagtcaaagctcaatgccattggctgtccgtggaagttaccgccggagataccagctctgtcttctttaaagataattgggttatctgttacagagttaatttcgatatttacatggtcgagtacgtagttgattgcatctttacttgcaccatgaacctgtggtgaacaacgaagagaataagcatcctgaacacggatttcaccctgacgtgttgtatttttgcttccttcgagtaattttaacaggtttcttgcagtagcaagctgtcctgaatgaggacgtacatcatgtactctgtggtcaagtgcatctacaacaccattctgtgcttcaaagcagagagcatctgcgatatctgcaactttgactaattttaatacatcatataaagcaagagcaccggctgctgttaaagcctgagtaccattatttaatgcaagaccttcttttgcagataattcgattgtaggaatacctgcacgtttcatagcttctgctcccggaagcagttcgccttcatagtaagccataccaagaccaatcataggaagaaccatatgtgataatggtgccaagtctccagatgctccaagagaacccttctgtggaataaatgcggtaacacctttatttaacatgtttaccattgtttcaacagtttctaaacgaataccggagaatccttttactaagttgttgatacgaagtaacataacaccccttgccacatcaattgggaatgggtcaccggcaccaactgcatgagtaataattaagtttctctgaagttctttacactgttcctgagaaattacaacgtcactgaatttaccaaaaccagttgtgataccgtaaacaactttctcctccgctactaagtcgtctaccacttttctggaatcaatgatattctgttttgcttcttctgctaattcgatttttgcattttcgcggcagattaaagcaagctgctccaatgttaaatcatttcctgtaattacgatactgctcataatcgcaccctcttttcgtttattttatagtgcaattatatctaatagtacgtcaaaaaaacgtcgataaatgtaagaaacgcacaatctattttttcgaattgttttattttttagcacaattccccaattagcggacatcattctttatgatgcggacatttgtatcagtacgttatcatggtaaaactgtaagttgaattttttctcaaaaactttgttttttcttttgtgtaaagcggacattcgcaatccgctttgctacttgctcatgaacgcagtcgctttgcgctctgcacacttgaagcggaggaatgcttatctgcgttcaaaaaaagaagctggctctttttagaacccagcttccttactgatctgtctgataaccgaaacggttgtcggattattcattttttctgtcaagcttactgctttcttataatgtttctttgcctggtctttttcaccaaaccgaagcagaaccagtgccatatatgcctcagcacgctccagtccccaatagtatccatttttctcaaaacaggcaatcgctttttcaagatacgttctggcctctgtatttttttccataaaataatatatctgacctacattagaataaaactgtcccagaccatttgttacgactttttctgttcccttttctatcgctattttataataagaaagtgcagattgatactctttcatttccctgcatacatctccgatgtaattatagcaagccgcaatattcattgcatactgtccgcttcccccgtcgcggttttcaaaaaactccctggcctgtgtcagaagtgccctggcttcttcatatcttccctcatgaagcagataccaacctttgagtctcataaaaatacctttttcatcggtatctgtctcatcgattaatttcattccctctttcacatactttttaaccaacaaaagattctctatctgaattccatagaaaatcatctgtttataattattcagacgtgctttattatcatttaaggtctctgcaattgcttcacttgccttgatattcgccagtccggtttcatattctccgatagcaatatcaaaacgaccttttacataatacatttccattttcatttcctgaagctgatgagaatctccttcaaaccggattacctcttctgccaggcgcaaaatttcatctgcctgaaaagaaagttcctggttatcgtcgccatattccatctcccaatgaagaacaggaaagttttcattgactatcgtataatattctttcaaatatgcaattttatattgatataccttcaccagattatggcacttctcatagtggtgaattgtcattgggagatacgcaaaattttttttccctgttgcttttgcctcgtaatattctgctaaaatctgatggtatgctctctttttacctacactttgtttgtcataaatatactctttaaacacctgatgttcaaatttataataaacattccagcctactaagagttctttgattaaatgtcgttcctgaagtttctctaggacacgaaccaatgtcaggcgatccatatccagatgcaaaagctcaatctcttcgatactgactttctccggaaacagactcatacagtttaatacctccaattcctgttccggcagcccaaccagacgcgcttttatcacattgttggttttctgtgatttttcaagggtataccctttttctttcatcagattaatggattccatcaggaaaaatgcatttccttctgtcatgcggtatacattctgtcgtttcttttgatcttcactcaactccggaagaaacttgcataaaatttcgttggtttctttttcattaaacggaaacagattaatcacatgaagccagcctttttttacaatgttatttaaagactccatcacatcggcatctttttcctgattaaacgtgcacatcaaaagaatcttatgcgtaccaaaagtaagaagcagacgatttaacagctgaatactggtctgatccatccactggatatcatcaaaaaacagaaccactttattgtgctccaaaatcttacggaacatgtcaatcactgcctgctccatgacctgataattcagtgcaccggattttccattttcctccatgacttttcccttaaaaaaatgttccagctgttcccatttttcttcactcatggattctcttaaaacctgataatccgccctctgttccacttcccagaaaatatcactccatggacgaaggaaaaattcggattcctcacgatagcaggccgcatacagaccaatcatctgatagccctttaccatctgcattgctttatcaagcagtgctgattttccaacaccgtcttctccgccaattgccacacatctgggacatccatcttttgctccgcccacaatacattcactgatttggtaaatttcttcatttcttccccagaatggcaggttccagataacaccatctgagtttgtatttcctttcacattaaaaatccggtgaaataattcggttacttctgacgatggttctacgccaagctcatccgcaagaattttctccaaatcataatacaatttgattgccatattatagtttccatttaaggcataaatatccataatttcataatacagcttttcattatacggatcctgttttaataaaatattactatatttttgaatttcttccatattttttgtcgcatccgctttatacagtttttcacgtgccactttcacgaaccgtttattatactgttcctgcatggctgaaatccattcctcaaattcataactgtttttaatcatgaaatgagaaagaaatccctgctcctctgcatcaagcaaattctcatcattgagattatcccagtcaatttctggcatacactccggattaagagaaatgcttgtatgaccaactgtcacaaggatttcttttcctaagagtttttttatctgatatactgcttctctaaggttttttcttccaacattttcgttgtccgctccccaaagcacagatatgatttcctctctcgttgctgttttctttacacacaaatagtaaaaaaagccctccgccttcttatatggaaagttcactctctccccatccatctccacataagggcgtcctagaagatatactttaatatttgccactttttatccctcacatttgtaatagaagaacagatgaatattgccatttttcattctgtccggtatctttgatccaggtacaaaaccatacccacttttcagttctatattttagtatactctactcgtacaacttgtgtcaactcttgtcaaattgtctaaaaatttattgaaaatattttctttctagtataagataaacttatcatcaatcttcagagggggaatcttattgttacgaaaaccaaaaatactctattactcaaatggacaaactcaaaaagaaaaagccatcgaaaaagccgcaaaacgccttggcgcagattttatttccatttctgaaacagattgtacccagaccgtcggttatcttgctaaagtaaaaggatttccagtgcataaaacttctattctggaaaacatctctgctgtctgtcaggatgtgatgattctctgctattttccaaatacccgtctcgaccttttacttgcatctattcgaaacggtgaaactcctgctgttgatttaaaagcaatcctgacaccacaaaactgcttctggactttttctcagctttatcaggaattacttgaagaacatttaagtctgttttccaatcaggaatgacccattctatcttatcatagcacaactacattaataatatagaagaaaaagtcggttttcgagatagaaaaccggctttttcttcttagaacatctttttaccaaatggattttttatttcgacaagcttttttactactcctgctgaaatagtgtattgaaaacctgaatatgtcgtttgacattttcataagttccctctgtcattgctgtatttaagtcaaaatagttatgcttttcatttgaagcaatatattcttctactttctttgttaaactgttaaaacttgctgtcgcaatatttacttttctgattccaagtgaaattgctttctggaaatctttgtctgtaattccgctccctccatgcagtaccaacggaatatctacattttcatgaatcttttcaagcacatcaaattccagtgttggagctaccggataatttccatgcgcattcccaattgcaactgctaatgcgtcaattcctgtctctttggcaaatacctttgcatcatccgggtctgtacaacggattccatggtcacagcttccatcttcacttccaccaaccagaccaagctccgcttctacagttgctccatattgttttgccagctctactactttttttgtatttgcaatattttcttcaaatggaagagtggatgcatctaacataacagaagtaaatccaagttccagcgctttctgtaccgtttcaaatgtaagaccatgatccagatgaactgcaacatctactttcgcttcttttgcagcctgaaccatcattggtcccattagatgaagtggagaatgtttcagtcgcacctctgcaatctgaagaataatcggcgtatctaattcctccgctgcctgaattgcacctcgtaccatttccatatttccaacgctgaatgctccgcatccaatattatttttctgtgctctttcgagtaattctttcatttttacaagtgacataatcattctccttcctgacaaactgctgtctgacatgcatttactttttcttttttaatttctctctctaataaaattaaagaaatcaatgcgagtgctgcgctgaatgctccactagcaaatacagcgttgatgtcatatccatttccaagcacggtattggtaattgccggtgcacttagagttgccaccgcaataccaaacataacatatccataattttctccagaatgttccattccaaaaatagaactcgataaagatgggaaacttcccataattccaccataacaggcatacatcatcacaacgcatacagttgtaattcctgccggtgcaaataccaagagtaacattgcactcactgctaccaccaatactacttttacacagataactcttcctactttatccgccgctgtcggcagacaaagccttgtagctgcattacagaccgaacctgccataaccgccgcaactgcaactgaagcactgattcccctgtccatctgtaccgtctgtgacaatggagataaaatcagatatggaatcaaaccaaacatcatagttgcaagcaggaagtaaaatttctttgtgcggaacatttctccggatgtatactgttttcctgtgtacaccggctttccgcctgcctgtacactgcctgttccaacttcccctgtttttggatttcggataaagatacttgccaaaatccatgagattccaataaacgttccgattattaaaaatgttttttcaattccaactccagaaagcaaacttctcgaaaccggtgccatgaaaaatccaaacagaccgtttgccgttacaatcacacccgatgaaaatccggttcttcccggaaaccatttctgtgcggtagaaagaatggttgtataaatcattccctgtccaaatccctgtaacaatccatacgtgatatacatcatgaccggtgatggtctcagtgccagtgcacttaacaaaatactggctgtaaaaattgcaccgcccgatacgattgcaatctttggatttctcttatcctgaattcttcctcctacaatatttccgagtacaaatgtgacaaaactcagataaaaacacatcgatgtctgaccctggctccatccggttaactccattgcatacggctggtaaatcgaccagatatgtggataacctgtaaaaaaaatggcaaatgcaccaaataccagtatcagatattttgtaaccgctcctgtcctttcttttttcatagcttctccctcttctttttgataatattttgaatatcttttggttaattcttgattataaattatcatctttttggtaattcgtcaatagtcttttcaaaatttttaaattttgcttcacaagttactcaaaatattatacaataatactcacaaaacaactttttgaaagagggtttaatatgagaaccaaacgaattgacttaattgaacgttatatagaagaagaaaaactggtttccttagatgtactctgtgaaaaattcgctgtatccaaaaacaccatacgccgcgacattgaagaactggtcaaaaaaggcgtcgtagaaaaagtatacggaggtgtttcctttaaagtaccaccatccgataccccactcgttccttatgaaaaacgccacactgtcttaaatacagaaaaagataccatctcaaaaaaagccgcctcttttgtaaaagaaggcgacattatttacattgataccggaacaacctgcttaaatatggtcgattatctggcacatgttccatgtacaattattacaaacagcctgaggatttttatgaaagctgtacaatatccggatttgcagattatttctcttcccggcagactaaaccgtgatacattatcctttgtcggaagtgaaattccaacctatctgcgtacttacaacattacgaaagcatttatggcatctaccggagtcactattcaaaacggtctgaccaatgcctctgccgatgaatatgcaataaaaaaaacggtcgtagaaaacagccagacccgctttttactctccgaccatacaaaattcgggaaatttgcactcatgacttattgtccacttagtgaaattcaatatttgattacggatactacgccacaacagaaatatctggattactgtaaagaacatgaaattataatagaagtgacaaaataagtttcgtacagtgtaaattaagcagctgctatattgacaccgaacgattttctcctatacaggcagagaagtgagacgtagcggtgactacgacgattgacgaaaacgcattaaataaaaaacggctctcaatcacttgaaagccgttttctcagttcttatacaaactgattacatcctttatcataagtataatcaatattgcccaatttcttctctaattcgcttttgtccaaattcattgcctggcacatatcatctaaagaagaatagaaatctctcagtttcaaatttacaaaacttaacaaaatcattgggtctttcggtatcattttactttactccttcttcacgctttgcggtcaattctccattttctacgtctatgacgatggtatcttccgctcttacacttccggaaagaatcaattttgcggtcagtgtttccacatatttctgcagatatctcttcagaggacgagcgccgtataccgggtcatatccgccctcaataatatagtcttttgctgtatctgtcaagcgtaaagataattcctgatcttttaatctgcgattcaaatcagccacaagtaaatcaacaattccaccgatattctcttttgtcaatggcttgaacattataatttcatccagacgatttaaaaattccggtctgaaatgagcacgcagttctgcatctactttgtcccttgcatcctgactgatttcaccattttcttcgattccatccaacaagtaaggagaaccgatgttagatgtcataatcagaatcgtatttttaaagtctacggtacgtccctgtgaatctgtgatacgaccatcatccaatacctgtaacaatacattaaagacatcaggatgtgctttttcaatttcatcaaataaaactacggaatatggttttcttctgactgcttcggtcagctgaccaccttcttcgtatccaacgtatcctggaggcgctccaattaaacgagacacagaatatttctccatgtattcactcatatcgatacgcaccatgttctgctcatcatcaaacagcgttgccgccaaagtcttagccaattctgttttaccaacaccagttggaccaaggaacaggaatgaaccgattggttttgttgggtctttaattccggctttggaacgaataatggcatctgttacttttgtaaccccttcgtcctgtccaatgacacgtttatgcagttcctcttccagaccaaggatttttgttttttctccttcggtcagttttgctaccggaataccggtccatcttgaaataattcttgcaatttcgtcatcggttacactttcatgtaccagagataaatcctgatttttcactttttcttcttcgatttcaagctgtttttgcagctttggcatttctccgtactgcaatcttgctgcctcatcaagattataatctctctgcgctttctgaatttgtttattcatatcctcaatctgctcacgcagtttggataatttctcaacggaagctttttcattatcccactgggcttttcttccattaaattcatcacgcagttctgccatttctttctgcagttccaccagacgatcctgacttaaacggtcattttcttttttcagcgctgcttcctcgatttccatctgcatcagtttacgatttaactcatcaagttctgccggcatggaatcaagttcggttttaatcagagcacaggcttcatccaccaggtcaatcgctttatccggtaagaaacgatccgaaatataacggtttgataatgttgctgctgcaaccagggcgctgtctgtaatctttacgccatggaatacttcataacgctcttttaatccacgaagaattgaaatcgtatcttcgactgtcggttcatttaccataaccggctggaatcgtctttcaagagctgcatctttttcaatatactgacgatattcatcaagagtcgttgcaccaatacaatgcagttcacctcttgcaagcattggttttaacatatttccggcatccattgcaccttctgttttaccagcacctacaatcagatgaagttcatcgataaacagaatgatttttccttcactctttctgacttcttccagtaccgcttttaaacgttcctcaaattcaccacgatattttgcacctgcaaccagtgcgcccatatcaagggcaaaaatctttttatcttttaagccctccggaacatcaccttgtacaatacgctgtgctaatccttctactgctgctgttttaccaacaccaggttcaccaattaaaaccggattgtttttggtttttcttgaaagaatacgaatgacatttctgatttcggcatcacgaccgataactgggtcaagtttctgctgtcttgctttttctaccaaatcctgaccatatttatttaaggtatcataagttgcttccggattatcagaagtcactctctggtttcctcttactgtactcaatgcctgtaagaaacgttcccttgtaattccatattcctgccagaatgatttcatagtcggactcgggttatttaaaagagccaaaaataaatgttcaacagagacatattcatctcccatcgctttggcttcgtcctccgcactgaccagtgctttatttaaatactgaccaatatactgctgacctccggacacttttgttctggcatttaatgcctgttcaattcgattcaggaaatgctctttctgaatctccattttttcaatcagcttcagtatcaggctgtcctcctgatgcaccaggttgtaaaccagatgctcctgctcaatctcctgatttccaaattcataagcagtcttttccaaatcctgtactgcctgaagtgatttctgtgtaaatttgctaatgttcataaaaatccctccatctatatcaaaggctattgttttcttgttctattgcaaatataacactatttgttagcactgtcaagaggtgagtgctaattttttaatattttttttgcaaaccttgattttacgggtttgcaacaatttttctatctgcacctgttccttattaagcggcacttcagcaccattagtgccatcatttgcaccacaattaatgccaataacgccatttttggtgccattggtgtcaatcatggcgttattggtatcaacctaatctcgataagtattcatacgctctatcgtttcagttattggtaatttccaagagccttctctatatattcctgtcttaattcctctgccagatactcatcgctcatacaatgcatatcagaaacaccgtcacgaatcagctgataaacctgagaatgataaaggaaatccaacgccgcatccaatgaaagtccctgctgtttagcaaagcattcgataacacggctatattttttctggagcaaaatcggatttgctgtcatagtgtttcactcccttcaaaatacaacaaagacaatgatttctctgtacgaaaacaaatttgcaggtttggtttttcgtaacgcaaacggttgatcgcttctatcttatcaatcagtccgtcaaagaacagctccactgtattgaacaccttattattgacaacaccgcccactacaaggtcataatctgtcgaatcttttccactgcggcaattcaaaataaaatccaaccactcctcggaataggaatcaaatttcagtgttttcagttcggcttctctaccttcatcgtattcatactgggaaataataccatctttccctcggcgtttaaatttgccacaccacttcgctgcctgttcatacagcggcgtgacatagacctttcgctttcaatgtcagattcttgttcttgaaatggtgattactcattaccgtaaaattctttgttctctctacacgaaaaatctgtgccatgctcccatcctcttttttccgtttcgctacgcagcttataaccgggaatcttccagaattttcttacatcccctccccataaattacaacactgtagcctttctgctttttgctctgatacattgccccgtcagcctttctgtatagctgttcaaaagaagtctcttcatatccattataaaaacacgcaccaagacttatttctatactctttcccggcatctctatgacatcaatctgtcggatattttcaaaaagtcgttcaaaaaatttctcagctactgttcgctccaacattttcggcataaatattgcgaactcatcacctccaagccgcaaaaccacatcactgtcacgacatgttttccgtaacttctccgcaacagctataatcaccttatcccctacagaatgcccgtaagtgtcattgatggatttaaatttgtcacaatcgatcaggcaaaacaatcctcccgttttttcctttaaaagttcaataatccttttttctccgcttccacgattatataatcctgtcataagatctgtccgcgccagataaatcagcctgttctcacgctttttttcttcttctatacactcaatacagaaaagcacatgcagaagtcttccattttcatcgtagtctacaggaataaatctgcttcggcaccaacctgatattttatctataaattcatgtgttatgctgttttccccaagaagccgttcttccatcgtactgatatctagaaactccagtgattcctgaagttgtgattctatacatgttttctcagcaatatcattgatatatccgcaaaaatcatccctgactttatattctcccatttttttgaaatcttttcccaaacattccagaacctgatctgtcatttttacaatatgatatcttttggtctgcacatcaacccaatacatagatgtatagattttcgagagggatgaataactgctgagttttgcctctttatttgactttataaatgaattacgcaatttcagaaatgaaataagaagcgttcctatcatatccaaaaaagtagtaagccccctgtaatcactctttggaggattatccacaccaaaaaagccacttatctcatctttataacgcaaagggcataccaccacatttctcacattctgcgcttttaacatatcatacgatgcgcgatgttcttctttgatatcttctatatcagtgatactgatactttcgcccttggaaaacgtatcataccaccattttatcacatccatatcgacattctgcaatctgtctatctcaggaattactccttccgcgcaccattcatacgtattgtctgtgccgtgcctttctttacaatcctcaaaaatatatattctgtcagaaccgatatgtctgccgaaaaagcggataaattcattaatctgctcgtcaggtgtgtggtaattgagtgcagatctaagtgcttcatttatgaccagttcatactttatgattgtcttcatgttattttcctcctgaatgtctttcttatcttacttttttacattcaaaccagacggaaagaccttcttttattttctgctcttccacaggtttcataaaaaaatattctatccgaagcctgaacgcatgaagcgaaaaatcaaggtcactgcaccagatgattccacatttcggatacagggaacgaaggtgttctgctgcattcaggccggacactcccggtaatgcgagaaacaccactgtcggtactgttttcaatgtccgtgcaaaaaattgttcctgattctgataaatttcaatcaacggaaagacatgcttctctgtacagtaattcctgatatattccgcactgttttgtccttcctgttcctggtcggtcaatatggcaatacaatacacaatacccctccctttctatttcatgtactttcatttgttattctcattataagaaagccagaaattatttcaacaattctggcacgaattgacagaaaatggcacgaattgcaactccgtggtattgttttgtgctatactgttaccagagcgttttcgaaataactacaccacttgcctgtctgcggctatagattgcgcagatgaaaaagtctcagcaagcggaatttacttttgacactcacatcatttcataaatatatataaggaagagctactatgaaaattgcaatcgttgatgatatttcagacgaacggacactgctacgaaacagactggaatctcagttttccagacgcaatgtccatacagatatatttgaatatgaaaatggagaaactttcctcactacagcgaaagaatgccctttcactgtagtgtttctggatatttatatgaatggatccaatggaattgatacagcaaaagaacttcgcagatcagacactaactgtctgctgatctttacaacaagttcaactgaccatgctctagagggatttcaggttcgagctctgcactatcttgtaaatccctacagtgaaaatgatatttccgcactggcagatgaaatcctttctcgcatcccggattctgggaaatacatagatgtaaaggtaaacggcagtaatattcagattcccttccagaaaataatctatgctgaacatttttctcacatgattcacatccacactgccggtgaaagggaactgatcacccgccagtcctttgattccttcataacctccctgaaaatggattcacgtttctatcagtgtaaccgaggcgttgtaatcaatctggagcatgccgttgattttgacgactcaggttttcgccttgataatggaaacaatgtcccggtcagccggaagctgctcaaaaatgccagacagacatttatggaatttctgttccaaaggaggttctgaaatgactgacatacttcaacctgtacttgaactttccgtaatcattcccggcgtactgctagcatatctgcctgtaaaaagctatctaagacagacaccgcttaagctgacagcgtggcttcttcctcttcttctgggaatctgtattttcgggggagcagtttgctgtgccctccaccttcccaccagacggatcctgtttcctctgctgcctgttattatgcttatttatcataaaacattaaaaatctctgtctggaaatccgccagtatttttctggcagtctttgcagtttttgcatgtatcaacagtctttctcgggcagtcaatgcacttataactgctgacctgcctattacagaaaataagctgtggtttcgtaccggtgccggaattttctataacgtcatctgcctgctgtttgttctggcagcatggtatcctgtccgccactatgttcaaacaatgatcgcagacgaaaactttgcccagacctggtatgtattctggattcttccggtaatcttcatcggagtgaatctttttatgattcctaaataccgcggcactttatatactgggcgggtcctgcagtgttatattgttttaagtcttgtactgctcataatcctgctcctgttttatgtcatatttcttatgatggcagctagcctgaacagaaatgcccgacttcagcaggagaaccattttctttcccttcagcaggaaagatacgagaatctctgcatggccattgaagaggcaagacaggcgcgtcacgatatccgccatcattttgttcaactgtcctctctggcagagcagggtgacatggaaaaggtcaaaaaatatctctttgctgcaaccggaaaaatctctgactataacctccatttctgtgaaaatcaggctgttgacagtgttttcggatattattccacccttgccaaaagagaaaacattccttttcatgcactggtttccctgcctgctgatctttccatagatgagattaatctgtgccttgtattttccaatctgctggaaaatgccatccaggcaagtgtgaaaacagagcacgcccgcagaaagattaatgtggaagtttatcctcaccataatcatctgcttctgattcatgtggagaataccttcgatggcaaaatacagcaaaaaaacaatattttccaatcctccaagcgctccggaaacggcataggaatcgaatccgtccgccacattaccgataaaaacggcggtgcctgtgactttacctataaagatggtattttttctgcaaaaataatgctccgggtataatcagtaactgattatacccggagcatccacgactgccgcactttataagattattctctcattccaaccaacactttttaccttcaaacacaaatccataatgtctgatttcttttcgctcaaatccccgagcaaataattgtacataaaaattcctgatttttaattctttttgcgatttgcccgttccagataaagaaagaacccaatatttaaaataattcccacgattgtggatatcggtgctgccagaccaattttggtcaggcttgcatttggctgaatactcataaaataggccagtggcagacgtactaaaagcgtctggattaatccctgcgccataacccaaagcgttttattatttccattaaagtaaccaatcatactaaaaagcacagccgttacaattgtctctaatgcaaatcctttcaggtaatcataaccattttgaataaccgcagcatctgtcgagaaaaatcctgccagtacatcccctttaaacatgacaagcaaaaatacaacgcatccaactgcaagtcctacgccaattcctgtaaccatagatttctttgctctttttgtttttcctgctcctacattctgagaaacaaaagaagccatagactgcattaaagcacttggtacaagcattgcaaagtttacgattttgcaggcaactccatatccagaagaagcttccagaccaagtcggttaacaaaggcacataatgcaaggaaagaaagctgggttaaacattcctgaagtgccaatggtaatccgattttaaggaattttttacactgcggattaaatcggaaatcgctctttttaattgcaaatggaagctctttctttaatagaagaatcactgcaaatacaacgctgagtgcctgtgccataactgtcgcaactgctgcacctgctgcatctttatgtaatactgcaacaaaaaacaaatctccgattacatttacaatacatgcaaccaacacaaacaaaagtggagatttgctatctccaagacctctgaatattgcagacatcaggttataagctacaataaaaaagataccacttccgcaaattcgcacatactgagaggtcaaatcaactgcctctgccggtgcctgcattaaaacagaaatcggacgtgcaaaacataccataataataaataatccaattgaaatcagagcaaatacaacaactgcaccaccaataacagctccaatctgctgtggttttttctcacccagataccgtgcaatcaaaaccgtaatacccattgcaaactgaatcaccacaaatgtaaccagatttaaaacctgacttcctgtagaaactgcagaaagtcctgaagtcgaaccaaatcttccaactaccagcaagtcaactgctccataggctgcctgtaaaatcaaagctccaagtaccggcagcataaaaaatactaatttctttaaaatactcccttgtgtgaagtccgctttatcattcattctttatctctcctctcacacatcacctgataaaatttctcaattactgctatcatacaatctgcttcttcttccgaaatatctgccaaataaggagccagctcattaaaatatttctcattgtatttttcagatagcttctttcccttttccgtggcagataaatagataattcgtccatcctccggtgagactgtttttttgatatatcctttttcttccatttcttttaccgtccttgtaacaccgggtcttggaagatttaatttatcactgatatccgatattttcacctgaacttcttttttctctaaagctagaatcacgtccagataatgaatataagacggagcaactccatttggaagtgccggaagtaactcacggatacgttttgcctgataacaggcatctaacattcgcttaattttttctgttgtcatctctcactctcctttttaaattttagttaccgacgttaattaccattgataattatacagatattttcctcattgtcaattcatttttttgcttgcccgaaatttttctttgtgctactattttcttagaaatttttctaggaggaattttaagatgagcgatgtattagaacaaatgaaaaccagaagaagtgtcaaaaaatataaaccagatatggttccacaggaaatcattgacaaagtgaccgaagccggactttatgcggcaaatggaatgggccgtcaggctactattatcattcaggtaacaaacaaagaaatgcgtgacaaactctccgaactcaatcgtcaaatcggtggctggaaagaaggatttgacccattttatggtgcgcctgccgttttagttgttcttggaaaaaaagactgcccgactcatgtttatgatggcagccttgttatgggaaatttaatgcttgctgctcacgaactcggagttggaagctgctggattcaccgcgctaaagaagaatttgaaacagatttcggaaaagaactgttaaaatctcttggaattgaagacgaatatgaaggaatcggacattgtattcttggttatccagaaggagactacccggaaactccagaaagaaaagaaaatagagtatttacaattcaataatcattaagggtgtagaagcaacagactcctacaccctttttagtggatttttaaagcacattttgcaaaaaccaacagataaatggcaatgtgataatcgaacaaatcgtggtaataaataccccacccattgcgtaatctccatctgaacctgaagtatttgccatcatcaccaccgatgtcataaccggcatccctgcaatcaatgccattgttaactggatttccgatgaaacagaaaggaatcctaaaagaacaaacaacaaaattggtgccagtatcatttttgtaagcacgattccatatagtgcgaattcttttagatgttttccaatgtgaatacttgcaaaaattccacccacataaatcattgcaagcggtgacgccgttcctcctatcttttgaagtcccatatccagaatccgtggctctttgatttcagttaagaccagaaatactgcaagtaaaattgcaaccgttgccggattaactaatttcttcgggttaaattttccttctccttgcggagttgtaaattttactcccaaagtccaaagcataaactggtctattatcgtaaatactgaaatatataaaatgccatttttcggaaaaatgcttgtaataatcgggattcccataaatcccacatttccaaacatcgacattgcctgatagattcctgctctgtctcctttcaaatgaaataatttcgtcatgccaaatccgcaaaaaagcataaaaaaataaaagccggcagtaataaacagtatcaaaacagaatgaatcaatgtttctttttctactccatctgtgatatttacaaaaaccagaatcggtaacgccatttttactacaaatctggaaatggcttcaagcatttcactgcttaataccttcgctttgattaaaatcacgcctgccagcagataaataacaaacaaccccatctgttccagcaaaatttcaaatgtattcattttctcttttcctctcatttctttccctactaatctatcgcattttgctattttcgtcaaattggcctttgctatttttaccgagtttttgtatacttttcttatctataagacgtttttattctaaacaaggaggcatttttttatgaaggaatacgaaatttttatcgaaactatgaatccctgcggtggcgcaaaatatgccaaacaggaaatcatcgaagccgaagctgaaagcccggaagcttatatcaaagagcatgcgaaatatcctgttcttgagactattaaaaatgcggatggagataccgttgttacgacagggaataagaatgggtatttgattcggtatacgtttacggagtgaataaaaaaatcgtgaatcagctcttcccctgattcacgatttttcatttatttttttcctaaccaatacggttccatatatcctgcttcacaaagatttccaactccctgtcctagtccggcagaagacaccggagcttcaaaatcctgtgtatttccatctgagccaatatagcggatacattttgtttcgtcatttggagacatgtagaatcgatattcttcctgtcccttatagacaaaggcaaacaacagagtattattttcatagtaaaattcagcggaataatcctgaggcaaatccgataaagttccagaacaggctccattttgagagacaatcttttttagatttccattttctgtatagattgccagaccacttgtgctttcatctttattataattatttaacttgccttgcgtatcataataaacatcacggatatgctgaatcatttcctcctgtgtctgtccctgtgcatcccaggtacttgttgtctgatttggctttgttgtcgtatccgtagcctgattcgatgaagtggaagtctctgcattgctctgacttacttcttcagcttctttctttgcctcctctgcctctttagcttcctgctcctcatattttttccatagttctttttgttcttcttcctctttctttttttcctcttcttttttcttttcgtcttctgttttttcttcctctgctttcttcttttctacttcttcagactcttctttcttttcgtctttgcattcttctgttttgcttaccaactcttcctgctgctgcgcttcctgtttcttattttgaatcaccattccggttacaactgctcctgcacaagctgcaattgccagaatcgcaatcaatatatacagcccaatacgttttttctttttctcttctactaaagctgtaccacaaattttgcaaaatttctggttttcatcatactgctttttacattttggacaaatcttcattttctttctcttttcacctcaaatatttttacctataaaatacggctgtattatatcacaattttttcaaaaatcaaatctgttttcttttctttttctaccttataataaacttgctaaaattgacattcaagtagaaaggattttaatcatatggaacaatttctcgcaggttttgaggcattaaaagccaacatctttgataatatgattgaacaacaggctaaacttggttatcgtaaagaacctgtccgtctttactatccacttagctctctcaaccatttttttaataaaaaagcagactcagatgaaatgcagcagatactttcggattttccggtttatacaaaagaacaatgtggagaaatttctgccacacataaaggagaacgcttttgttttaccatctccgaagaggtttcggagtatgttcacacaaataaacccggcaatatttttatttgtgaattaatccagcttttaacaaagcatagtacaactcttgaagagataattacgcttttcaagtctcaaccaaaagaatccgttatcgaaccagtcaacaatggagaattcgacattttaattcgttttgtaaatgataaagaccgctattactattgttttaaagatgaaggttgccatattatctatcatcggttcttaccggaagattacgcagatttcgatttttaacaaaacaaaagagcaggagaacttcccattctcctgcccttttttaatttacagaattttttttatgcatctatctgatttaataagttcaccatttcaattgcagaaagtgcacagtcatatcctttatttcctgctttgcttccggctcttgcaatcgcctgttcaatattttctgtcgttactacgccaaataacaccggcactcctgtctgtaatccgactgttgcaattccttttgaaacttcattgcacacataatcataatggctggtatcgcctcgaataactgcaccgacacagataaccgcatcatactttccggattttgcaagacgctctgccacaagcggaatttcaaatgctcccggtacccatgcagctgtaatgttttcttcttctactccatgtcttaccagtccatctactgctccgccaagcagtttatttacaataatctcattaaaacgagctgctacaattgctgctttcattccttttttggctactacttttccttctaatacattgatttctttcatgattttttctcctttttgtatgcctatgattttattgttttccagctaaattaatttaaaatgttttgaaacacatgtcccatgcggatttttttggtttccatatagcgtctgtcatactgctgtgttggaatttcaattggcactctcttcttgatttcaagtccaagtccactcaatccgtaaatctttgttggattattggttaataatcgcatggatttaactccaagatcttttaaaatctgtgctccaacccagtattctctcaaatccggcgcaaatccaagtttaatattcgcatctaccgtatcatatccttgttcctgtaattcatacgcctttaacttgttaatcagaccaattccacgaccttcctgacgcatatataatacaattccgcgaccttctgcttctatcatctgcattgctttttggagctgaggtccacaatcacatctaagagagccaaacgcatcaccggtcagacattcggaatgaatccggcaaagcacatcttctccatccccgatgtcaccttttaccaatgcaacatgatgctcctttgtgatatcatttacataaccgtaaattttgaaatgtccatatcggttcggaaaatccgcacacgcttctcttaacacatgtttttcgtgaattcggcagtaatcctgaattgcctgaatcgtaataaattttaattcaaactttttggcaagctcccaaagttcacttgtgcgcatcatcgttccatcttctctcataatttcacaacacacaccgcattgttttaaccctgcaagacgcatcaaatctacagttgcttctgtatgtccatttctcaccagcacaccgccgtttttcgcaatcagcggaaatacatgccccggctttctgaaatcctctggcgaaacgttctcatccacacacatccgcatggtaagtccacgctctgctgcggaaatgcctgttgtcgtatctttatagtcaattgaaaccgtaaatgcagtctcatgattgtcggtattttttgttaccatcggtacaaatccaagtttttctgcaagttctacactcatcggagtacaaataagtccctttgcataactcgccataaaattaatattttcctgtgttgcaaactcggctgcgcaaatcatatcaccttcgttttctcgattttcatcatccgtaacaagcacaattttcccttgttttaagtcttctaacgcttcttccactgtgttatattcatgttccatttccgttttcctccctgtcagattccgtatttttctaaaaattccattgtcaaatttgaggatgactctgattttttctcttctgtttctttaaaattcaatagccgttccacatattttccaatcacgtcgttttcaatattgatacagcttcctgactttttatcagctaatgtcgtttcctgtctggtatgtggaattactgaaactttaaatgttacatcatttacttctgctactgtaagactgactccatcaagacacaccgagcctttttccacgataaattttagaatcggtgcatctgcttttattgtaaaccagactgcattttcttccggcaatatctctgtaatcacaccacagccatctacatgccccgacacaatatgtcctccaaaccttccatttgctgacatcgccctctccagatttactcttgcacctgtttttgcttcttttaaactgcttcgccttacggtttctgccataacatcagctgtaaaaaaaccatttccaagagtagtcacagtcagacagattccattgacggcaatgctgtctccgatttttgtgccttccaacactttttttgcctgtatttttatacttccggatgagccggaaatgcttaatttttgtatgatacctgtttcttctacaattcctgtaaacacttcggtacctccttccggtaagtaagctgtacgtcttctccaatttttctgatgtcctgcagataaaattcttttgcgtcttttacctcacagattccacatccttctacaggggaaggtgcaccttttccaccaaaaatctttggtgcaagaaatacatgaacttcattaaccagattttctctcagcatgctttcatttaatgtaccgccaccctcaagcaaaatactgtcaatcttttgttctcccagtatctctattaattttttcaaatcgactcttccttcttttgaaacttccagcacctgtactccaagcatttccaaatctgcttttttctcctgttcggcatcggcacaagctatgattgtcggatactcttttgcactttgacaaatcttactttctaaaggaatctgaagtttgctgtcacagataattcgtatcggacttttctttccttcgattcttgtatttaacatcgggtcatcttttaaaacggttccgattcctgccatgattgcagtatattgatgcctcatttcatgtacgatttttctcgattgttcggaagtaatccattttgattttccggtttttgttgcaatttttccgtccatcgtcattgcatatttcatcacaatataaggtcttttcatctgaataaaatgaaagaataccggatttaattcatcacattcttctctcataaaatcctcttctacctcaattccctgcgctcttaaaaaccggactccttttcctgcaaccaaaggattcgggtctcttgaaccaattactactttcttgattccagcttctgcaattgcttcggtacaaggcggctgttttccataatgacagcatggttcaagcgttacatatatcgttgcaccttctgctgattcttttaaatgtttaattgcattgcgctctgcatgcagttctccgtatttttcatgatatccttccccaatgatacgtccatctttcacaataaccgcgcccaccagcgggttgggacttgtccatccaactccttgctttgccagttcaatggctcttagcatatattcttttttctgcattttctttctcctaatcgaaaaaaatccctgcaaataaaaagtttatctacagggatttctcatatttctaactatatatgaaacaaaaaggctctgaaacggaaatccatttcagagcctgatattcatgattttgattttttaatcagtcattcatttctcttcttccatccagactttactgtcggtatcggaatttcaccgaatcatgcctttcaaatttattttttcaggctcgcagactatcactgccggtagggaatttcaccctgccctgaagatttttcttatttacttgattaaaattatagtacaacaatttaaatttgtaaagtgcaaattttaaatttcttccagcacaatttcaaaagagacatcatctccaaccgctctttgaagtaaaactcctccactcatcaaagcaacacctgtgtacacctcttctgttccggcaatcttataatttttcttagcttctaagcccattagacgcagagtctttcttaatacatttggtttcgcacggaacaatacaccctgaaccaatatggttttcttatcttctgatatccaggaccatgctgacatcccatcctcaaatggatttgccagacgataataatcaccgttataaatcaaactttgatattctttataatgggtaacctgttttgcaacaactgttttttcttcttctgaaagctgatttaagtctaattcatatccaaagcttcctgccattgcaaccacacctctggtttcaattgaggtaattcgtcctgtctgatggtttggcactgcggaaacatgagaacctactgttgaagttggatagaagaaacttgtaccatactggataaaggttctttcatgtgcgtcggtatcatcactgcaccaaatctgtgggcagtagtacatcattccggcatcaaatcttccgcctccgccactgcatccttcgaacaatacatccggaaattctgatgtcagtttttcaagcaattcatacagtcccagcacatatctgtgtggcatttccatctggcgtcctctggaaagtgtagctgtataccagtcactgatactgcggttcatatcccatttcacatattcaatatgattttctcttaaaatcgcactcattacaccataaagataatccaccacttctggatttgacatgtctaatactaactgataacggcttctcatcggctttcttcccggaatctgaatcgcccagtctggatgattacggtacaaatcactgtcctcggataccatttccggttcaaaccaaagtccgaatttcatacccattgcattgattttctcaaccagggcttttaatccgccatttaatttcttttcattgacaaaccagtctccaagtccggaacaatcatcatctctctttccaaaccaaccatcatcaagtaccatcatatcaattccaagcttagaagcctgtcttgcaatatttaaaatcttttcttcgttaaagtcaaagtaagttgcctcccagttattaatcaaaaccggacgactgcttaactggtatgttccacggcagacatgatttcggatgatgtgatggaaattctgagacaattttgcaaatcctgttgtagaacaagataaaatcacttccggtgtgtagaacgcttctccggcttctaaggtccattcaaatgtgtctggatggattcccataaccaaacgaacctgttctaactggtctttttctacctgtgcctgaaatcctccgctgtacatcaatgcagctccgatgcagtgaccatttgtctctgtacaatctttttcacaaagcagaacagccggattttgatgatgactggaagttcccctgctgctgctgctctctgaaattccgtgcaaaacaggaactcgttctgcctgtctttccatagtatgtctgccataaaaatgcatccattcccagtctccatacggaatatccagacacatactatgcactttattaattacaatcggtgttttccctgaattttttaccaccacacttcttgtaatcacgtcttctttttcaaacacaccatacttcaaaatcacctctgcttccgttgcagtatctttcaaagtaatttctaatgtttctgcttcgtcttcttttgcatacactgccggaagccctggaatctcatattttccttttttaatctgatattccctgactcttaagtctaaagcattacttccatcttcatgagtaacagaaattgcagagattcgaaaatctccaactccgctggtgctgtattcctgtggcagagtatttaaagaataggttctttcattttctgcttcatagatatttccggaaaatcctgcgtccggataatccagaagataatccatacaacaatctgttttttctccataccagagatgattgagtactccaaagcgatccaccttcatctgataaagtgtgttttctgtttccaggttaaaaattttgtcctttactgtaattgccatacgttttcctcctaaacaagatttttgttttcactgtttgctctcgtatcttactttctattttaaccttttacagctccatttgctaccccatttaagatttgtttctgacataataagtagaaaatcagaatcggaattaatgcaagaatgtaggatgcaaatgcaagattataattcgtaccaaactgggtctggaaattcagctgtgccagtggcagagtatttttcccggttcctgacataataacaagtggagtcattacgtcattccaggttccaagtgccgttaaaatcgcaacggtcgcatgcattggagacatcattgggaatataattttccagaatgtctgccaggtagttgccccatcgatagaagcagcttcttccagcgtttccggtatattttttaaatatcctgtgtataataaaatattcatcggcatatagaaaaccagataaagaagtatgacacctaaacggtttccaagtcccatctgtgcagtctgttttacaagaggcatcattaagattgcaaatggaacaaacataccgctgacaatgtaaagatatataaatcgaaaggcctttttatgtgccatacttctcccaataacgtaacctgcaatagaatgaactaaaattgcaagtccaattgtcacaagtgtaatgagtaaactatttcccagagagttccagaaatctgttactctcattgcttctttgaaattatccagactccagcttgatgggaatgccagtgcacctgccacatcatttgtcatttcacttggctttttaaacgcaataatcactgccatgtacagtggaaaaaatactgtaacggttcccaaaatcaggatagctgtcaaaatacgatttacttttcctgtttctttcattataattgctcctccttcttatttaagactgtcatctggaatacagaaattgcaacaatcacaacaaaaaataacactgcatttgcactctggaatccaaactgtccgccatccataccatttttgtaaatcaaataagaaatagattccgtactctgtgccggaccgccttttgttaaagacataatctggtcaaataccattaacaggttctttgtgctaagcaccagattgatagttacaaacggaataacaagcggaagggttacactgaaaaactctttccatttgcttgcaccatctaacatagatgcctcataaacttcctgtggaactgtctgaagccctgaaatgtagataatcgtattcatagcaactgcctgccatacaccaacaaccagcacaccaatccatgcatttttttcacttgccaaaatactgttttgaagccatccaatatgaagactggttccaattcccggaaggatgtaagtaaaaataaagctgaaaatataaccaattaccagtccgcctaaaatattcggaacaaagtaaattcctcttaaggcgctcttaaaacgaattttgctgtttaatcccagtgccagtaccagacttaaaaaatttaccagtattgttccaacaatcgcatatttaaaggtgaacagataactctttccaacacgtgcatcggtaaataaatcaatatagttacgaaatcctacatattcatacgttccatagcctttataattggtaaaactatagataaaaccttttatcatcggcaatgtattaaaggcaaagaacaaaattaaaaccggaataataattgcccagaacgttttatctttatttgtcattttcttcttcataacaatctgtcaaactcctctcttatttctgtttttcctgatagtcctgcattttccggattaaatcacggttgtatctctgccagtctgtatcaaaacgcttcaggaaagtatctaatgcattttcgctgtcatctaacaaataagtctgtaccatcgcatcgacactcatctcacttggataatggtggtcatggaaatccgccattcttccttcttcgatatagcttctcatatcttctaattccggtgccagttcaaaatcaccttctttacatgcaattccgccctgatcatctaaataaatctgaatggtttcatcttcatataaaaatcttaatacttcataagcagcttctttatttttactttctttcagaacagaaaactgtaaatcaattccggagtttaacacattgtctgcttccgaatcatttgccggaaatgtaaacgaaccgatattcatatctggatttactgatttaatctgaggaatcgcataacttccaatcggatacatggcggcttctcctcttgcaaatgcggtacatgcgtcattatatccatatgcatatggattcggttccgcataagaaaccagctctttgattttttctgctgtctctctataagcatcagaaaaagttgcttctcccttattaacctgactgcaaatatcagaatctgtcagtcctactgccagagcattccacggtgccatacaggtccaggtatctttaaaacctaaatataatggctgtactccacttgccgaaattgtctcacataaagttgtaaattcgctccatgtagttggaatcttccagccattttcttcaaacatatctttattgtataaaatacctgctgcatttgccgcatacggaagtgcataacttccttctgtcggaatcagcttcaactcttcttccatatccagataagcctgttttgtttctttgagtacatctaagtctgataaatcctcaaacaaccctgcatctaaaaaattagaatagttcatatctccaccaattcctacaatatccggatagtcttcacggataaatctggtttttaaaattgtaaccgcttcatttggtgattcaattgttaagtgaatatcatcatgcgtttcattaaaccgctcttcaattttttcaaaggctgccactgcctccggcttataagaaatcatctcgacttctgtttttccatcggatgttttatttccacatccactaagactgactgcaccaagcaatatgccgccaagtacaatgagccctcttgccatttttttctttgccattctgactctcctccctgttcttctcttttttcttcttttattttaacatagcaatatgctacctatgaatcgcccgattctgctatttttatacccaaatgatagattttctgttataataaaaaagcaatatcgcattttgatatatattaaaaaggagcatcttttttatgagtaccgtatcattttctatctttccaaatgacaattttattgacctgtgcctttaccagtatggaaaagaacaatgcgaccctggacattcttttggacccgctacacgaaatcactatctctttcattatgttctctctggcacaggcacgcttatggctgataattcaaaaggaatcacacagacttattccgtgaaaagcggtcagggatttctgatttttccagggcagatcaccacttattttgcagaccaggagcacccctgggaatatatctggctggaatttgatggactaaaagtaaaagaagcccttcagacaacttttttttctttagaacatcctgtttatcgtgcaaattcaaaagagcttcgggaaatcttaaagaatgaaatgctctatattgtggaacactgcacagcatccaaattccatttaattggacatctttatctcttccttgacgcactgactcagtccactcattctaatgaactgacttccagcagtaaaatgagtgattattatattaaagaggctattcattatatcgagcaaaactttcaaaatgacatcagcattgaagaaatcgccggggtctgtggaatcaatcgaagttattttggaaaaattttcaggaaatccattggaaaatcacctcaggaatttttgatgaattaccgaatgataaaagcaacggagcttttaagcctgacttctctttctatttcagaaatcagtcaggccgtcggatatgataatccgcttcacttttccagagcatttaaaaatgtttatggaatttctccaagaacctggagaaaagaaaataagtaaaaaaaacgtggcaaagtctcatctattcagactctgccacatttttttattgatgcgctgtctttgtaataatagaataatattccggtcttctatcccggaacagtccccattcaagccgttttgccgaaagctcatcaaggtcatattctttctctaaaatttcttctttatcccttgatgcgcttttaagaagctctcctgtctcatctgttaaaaaagaagaaccataaaaggttaaggaagaggtctgtcctccattctcttcacttggttctaccgtttccagaccaattcgatttgcagcaatcaccggcataagatttgcggctgaatgtccctgcatacaccttctccagtgcggcatactgtcacattccaaaatcggttccgaaccaattgctgtcggataaaataaaagttctgcgcctaaaagtgccatgcttcttgcagtttccggaaaccactggtcccagcagattccaattccaattgtgccaaatctggtttgaaagacacgaaacccggtatctccaggtgtaaaataaaatttttcctgataataatggtcatccggaatgtgagtcttccgataaacaccaagaatcgtcccatcggcatcaatacacgcaatagaattgtacagattattgacttctttttcataaaaactgattggaagcacaactcctaattctttcgccagacgctgtcccatcagaaccgcttcgttttcctctaacggtttagcataatgataaaaatcataacgacgctgttggcaaaagtattctctttcaaacagttccggaagcaaaattatatttgctccatctcctgctgcctttcgtatcattttttctgctttttttctgttttcttctggatttttactacactgcatctgaattgcagccactttcacctgtctcattcttctactctctttcttccttccggaatctgctgtgtaatacaatgaatatttccaccacccgtcaaaatatctcttgcatctactgcaatgatttctctttccgggcaaagtttcttcattatttcctgtgcacgaacatcactttctttgttttctcccccaaattccggcatcacaactgctccattggaaaaataaaaattcacataagaagccgccagacgttccccttcctctctgacgtcttctccttcttcaaaacaatatccttccaattcttcttttgtgacacaaatcggaacatccggtatcggcagcttatgaatgaccagttttcttccctttgcatcacattcagactccagataatccagacatgcttttgataaaacatactgtgggtcatcttcattatctgtccaggcaaggactacctcacccggctttaaaaatgcacatacattgtccacatgctcattggtttcatccaggtaaatccctcttggaagccacaaaattttctctgctccaagataagatttcaacttttcttcaatctgctttttacttaactccggatttcttcctttgcttaacagacagctcgccgtgaccaaaaccgttccttctccatccgaatgaatcgaaccgccttccagcacaaaaggagctgcgtcataacattcatagccctgccaggcagaaaacgcttttgcaaatgcattatcaagcttccacgaagcataaagcccatcgacttctccgccccatgcattaaattcccagttaactgcacgcaccattctttcatttgctttatctgataccacaaaagtaggaccgatatctcttgcccatgcatcatctgttttagcttcaaacacagtaaccggatacggaatctgctttctttttaattcatttgcaaagttcgttgcctctgccacatcttcttttcttgcagctaaaaagactgcttcactccttgcaatcgcctctatgaccgctgcaaatgctttttttgcttctcttgcctcgtttcgccaggaacccggtctgcttggccatatcagaatgcagcctttatgtacttcaaattctccaggcataaaaaatccatcttgttttggtgtctgcatcttaatctctccgtttttttcctttcaagactgcgtaaagcggacattcgcaatccgcttcgctacttgctcatgaacgcagtcgcttcgcgatctgtcagtgggagctttcaactcccactgacagaagcatcccccctcacccgccgcttagtgctctgcgcacttgaagctggggaatgcttatctgcattcaaaattttcacgataagcgtcctttaaaatcttcataagaaaattcttttactatttccacttctccattttctttttttaatgcaattgcagggagcggcatcccattaaaggtattattttttaccattgagtaaattgccatatcttcaaaaaccaaacggtctcctacctgaatcggtttttcaaagctataatctccaatcacatcacctgccagacaagtcatagaagagagtcgataggtataaggttcttcacccggctgatatccattttgaagtggcgggcgataaggcatctctaacacatccggcatatggcaggctgcagaagcatctaaaatcaaaatctgtatttcattttttacaatatccatcacttccgtcacaagataacctgcatttaaagcaaccgcttctcccggttccaaatatacttctacgtcatatttttcttttatcgagctaatcagttttttcaaactgtcaatttgataatccggtctggtaatatgatgtccaccgcctaaattcaaccacttcatctgttttaaataacagccaaatttttcttcaaatgctgcaaatgttctgaccaggtcatctgcattttgttcacataaagtatgaaaatgaagtccttcgattccatccagatattcttctttaaattcactttttactacgccaagtctggaaccgactccgcatgggtcataaatttcatgcccctcctgggtagaacactccggattcacccgaattccaacgctgacatttgattcttggcaaatcaatttatgtttttcatattgggaaaaagagttaaaaataatatggtcgcagatttttaccaattcttgcatatcttctgttttatacgcaggtgcaaacacatgattttcttttcccatttcttcccagccaagacgtgcctcataaagcccacttgcagtagtcccgcttaaatagtttccaatcatcggatacaatacaaacattgaaaacgctttttgcgccagtaacacatgtgcgccggtttcctcttccaatgcatgcagaatctcaagattctctcttaattttgcttcatccactacatagcatggagtgggaattgcttcccacctcatcgtaccacttccggattttcttcaactacccatggaagtccatactcattcaacatttccataaatgggtccggatcaaactcttcaatgttgaagacaccgtctttatcccaaattttatttacaatcatagcagcacctatcatagccggaacaccggttgtataagaaattgcctgagagccgacttctttataacattcctgatgatcacatacattataaatataaattgttttctcttttccatcttttttaccggtgaaaatacagccaatattggtttttccaaccgtacgtggtccaagggttgccggatccggaagcaacgcttttaaaaattgaatcggtacgatttcttttccttcaaattcaattggtgaagtagagagcattcctacattttccagacatttcatgtgagtcaggtaactctgtccaaatgtcataaagaaacgaattctttttactcccggaatattttttgccagagattcaatttcttcatggtgaagcagatacatatctttttctcctacctgcgggaaattatattctcttttaatttccatcggttttgtctctacccaatgaccattctcccaataagaaccgtttgcagagacttctcttaaattaatttccggattaaaattcgttgcaaacggatatccatggtctccgccattgcagtctaaaatatcaatggtctcaatttcatcaaaataatgtttcagggcataagcagaaaacacactggttactcccgggtcgaatccacttcctaacagtgcagtaatctttgcttctttaaatttttcctgataagcccactgccaggaataatcgaaatatgccgtaaatcctgcttctttacagcgtttttcataaatctctctccattctttgtcatccgtatcttccggctcatagttggcagtatcaatatagtctactttacatgcaagacaggcatccataattattaaatcctgatatggaagtgccacatttaaaacagcatccggctgatattcttttattaaagcaattacctcttctgtcttatccgcatctacctgcgcagttgtaatcacagtctctgttgttttctgaagtttttcttttaaagcatcacattttgactttgtacggcttgcaacacagatttcagaaaatgttttgctgttctggcagcattttgtaatcgcaacctgtgcaactccaccacatccgataattaataattttcccatttttctacctcctgagtgttttattgattaatttttttcttcctcttctaacatatcttccacatatttcggaagcataaatgctcctttatgcagattcgtcgtataataccaggtctgaatttttcgttctttccatttttttgcatctaaatgttccaacggatggtacattttagacgcaaacccaaacagccaatatccggaagaacacgtcggaatatgtgcctgatagacacgactgattggaaaactatgacttgcctttcgatgcattactcgacaagattcctcatcttcatcataaaaagggcttccgtgctgatacaccataataccgtcttctcttaaggcacgataacaattcccataaaattctttagtaaatagccctgcattatgcccgagcggatcaatggcatcattaataatcaaatcatattcattttgctttaaacgcaaaaattttaatccgtcttcataaaagatgcgtactctcttatcctcaagtccacatgcattatccgggaaaaattttttacaaacctccacaaaaaccttgtccggctctaccacatcaatttcttcaatttcctgatagtgccctaactctcttgctactccgccatctcctccaccgatcaccaatactttttttacgtttggatgtacggccattggcacatgtacgaccatttcgtcatagataaactcatcttgctctgtaaatacaatgcttccatcagcacttaaaaatcttccaaactcatccgattcaaagacatcaattcgctgaaaatcggtctgctgctcaaataactgtttctgtactttaaccgacaactttactttttctgtatgataatccgaaaaccaaagctccatcttctttttctccatttcagttcgatttagactaatacatttaagtactctacttctgaatccatggttccttgcatggaacagcctttttcctttgcatacataatatattcgataatttcttttgtaatgcgctctccgggagctaaaatcggaattcccggaggatagcacattacaaactcactgcagattctgccttctgttttctgaatcggaagcgattctttcttagaataaaatgcagtctgcggagacatgacaacggttggctctatatattccatacttggcatctcttccggctttttggaatacaatcgcttaatatccgcaagtgctccgactaagcgctcgatatcctgaatccggtctccgattgaaatataagcaagaatatttgcgacatctccaagttcaatttgaatatcatactcatcacgaagcaaatcgtatacttcaattcccgcaagcccgatatctcttgtatagattgatagctttgtcacatcaaaatcatacacactgcttccatttatcatatcttttccatatgcataatatccaccaatggaattaatttcttctcttgcatattctgccatctgacttacctttgcaaaagactctcgtcctcttagagcaagattccgtcttgaaatatcaagacttgaaatcaaaagataagacgcactcgttgtctgagttagattaattacctgactcacatattcccaattcacattttttccggtcaaaagaagagaactctgtgtcaggcttccccctgatttgtgcatcgaaacagaagccatatccgctcctgcatccatcgcacagacaggaagattctctccaaaataaagatgcgttccatgtgcttcatctactaaaacaagcatattatgtgcatgcgccagctttacaatcgcccgcaagtctgaacagattccataataagtcggattatttactaaaaccgcaactgcatccgggttttcttttatcgctttttctacttcaaaacgttccattccaagagaaatccccaaccggacatcccgctccggattgacgtaaaccggaattgccccacatagaaccaatgcattaataacacttttatgtacattcctcggtaaaatgattttatcccctgctttgcaacaagaaagtaccattccctgaacagaagaagtcgtacctcctaccataaaaaatgcatgctctgcacgaaatgcctccgctgcaagttcttccgcttcttttatgacagaaacaggatggcagagattatctaacggtttcatggaattcacatccaaactgacacatttttctcctaacaattctaccagttccggatttcctctgcctcttttatgtcccggcacatcaaatggaacgactctttttcttttcaaagtttccagtgcttcatacaccggtgcccgcatctgccgatgctcttctttgttatttcttctgttatatttcatttctcctccgatgttgtgtcattccctctccaaaaatagaacgcaatttcctgtaaagtaagcaaaaaaaggacaggtaattccatcacctgtcctgtagtatcattctacaaaagtcattttaagtttatacactatgcatccttatgcatatttgcaaaaaccattttctttcagagcttatcgttgacgcttccgccagcaaatatttgctaaaactactcttattgaccgtttcacaagtgatatctctatctgagagggtcgcaggttactctcctgcacacaacttataaaatttgagcttctaactcaatcaataatgcggtctttcaccgcagtcggcagctgccccgcctgtccgtatgggcttaaccaatttcttggtgggcaaatatttgcatgaaaacaattttcgcattcatgtattttttagtataacataggttttttttaattgcaagaaatcttttatctggttaacttccgaatccactttccataattcacgatcaaaaatgccgggatacatttaaaccactgatccgcatttaaacagcacactacaatttgcggtgacgccttgaacacaaacgctgcaaggaaagaaatcggaagcacaatcccccagatactgataatatcaatctttgctacaatctgaggacttccgccgcctcttataattccattattggtcggcatctgataagacattcctacacagacggcacttaaaataataagaaaactgttcgccatcgctcttgtctcttcggataaattataaattccaagaattggaattcgcaagaaatataaggtaaccccggaacaaattccaattgctaaaaacagcttttggagttgcttggaataccgaatcacttgcacttcatctccctctccaactgcttttccaatgataacagaagctgtggagcacgcaccgactgctgctgatttcactaaaagaaacaggttggaggcaacactgttggccgcaattgcacgtgcagtcatatgacctaaaattgcagtttgaagtgcagtattgattccccaaaggctttgtaccaagaacatcgggcgtgttacttttccatagtctgcaaggatttctcgatccatttgctgaaagtaatcccggaatttcaaatctaagatcttttcttttcttatactataaaaaataacaattccacattctaagattcgagcgaccaaagttccaattgctgcacctgtcacaccaagcctcggcgcaccaaaccttccgaaaatcaaagtataattaattccataattaactactaacgtaacaatcgataacatcaaagcaatttttaccacctgaacggtacgaagagtagcaagcaaaattgtcgtaactgcaaaaaacagatacgtaaaccgaatgatggaaagatacacacagccttcctttacaattgcagtctctgttgtaaaaatatgcattaccgatactggcaaaaaggtcacaattccaaacaaaatcaaggcaattccaatcccaaaacgcattgcaacattgccgatttttttaattgaaccggtatcctttttgccaaaatattggctgcctaaaatgacggcaccttcagcaaatgcggataacatctgctgaaatataaactggatttgattgaccgctgtgacaccggataatgagatttcgctgtaagcgcccagcatgatattatctgtcaagttgacactaagcgttaacacattttgaagcactaataaaatataaattgaaagaaaatttttgtaaaagccccgctttttcatggttctttcttctcccgaatctcctcttcccatttatgtaattttcttgccgcttccggattttgcttttccagtctcttttcaagtctttccctgctcttcttcaagtgctccacaatctctggatgatgaatcaataactgctgctcaattttacgtcttcgtttttcaatcaattgcagaattactttgcgatctcctcttaagttttccggaagttcatctaaatgcaattccattcttcttaatatttcatcctcatcaattgctccaagcgaatgccagtttttaagtttttcttcaattccaagctctgcaaggcgctccaaatccggcagtttatgcagctgttccatcacctgatgcactttcttttcaatttcttctactgcatcatcaccaaaggcccaggcaaattcttctaaggtattttcctcttctgccggtatcattgcctcatggactgcatgcaccttttccgaaatttcaagcggacatggagaaggaattccggcatcatgcaaagctgcaagaatggttcggcggacttttccttcttcaattaaatgtccaattccaaggcttctcatctgttcatttacattttcggaatgttctgtgacataaaaatgaattccctgtttgtcaaagttttttgctatcatttccagacgatctgccgctgtgatatctatactgttgattgctcctgcatctacaatgactacttttgtatcttctttgatgctgctttcaatatcggactggaaaatcttaatgtttgcaaaaaacagattttcgctgaatcgataaataattgtatttttaatcggataagcattgcggtttcgttttaaatcataataggcttccttgcctggaatcataccataaaaagcacgaggcggattggttgctcgtaacacaactgctataaaagaaagtaacaatccgattacaacaccataaatggttcccaaaaacaaaacactgatgcacgctgctacaaatatataaaattcattccgacttactttaaataagcgaattgccagatgcaattccaccacattcataagtgctgaaatcacaatcgcagttaacaccggcacaggaagataaccgataaagccggttgcacagactaaaacaactgccatcactgcacctgctgtaattgaaactgcctgtgttttcccttcatactgctcattcattgaagttcttgaaatacttccattgaccggacagcatcccacacatgccgatgcaagatttcctgctgcgcacgccagaatttctttattttcattaattttatagccattttttaaggcaaagttattttctgataataaggtttctgacatgataaccgcagctatcatcagacttctccctgccgcctgcgtccagtcaatccctgcaaattgaaacatatgaatttttggaaggccactctctactgcatcaagcaaaatcactcctcgttcatccacatgaaacagcaacgttactactactccaaccgccataatcacaattgccatcggaaatttcggaatcagtttcccagccagccgaagaaaaaccaacgctccgactccaagtgcaactgacaaccagttaatttccttacaggtttcaaaaatatggtgagcaagttccggtaattctcctgaacccgccttacctcctaatatctttggtatctgcattaaaataattgtaagcgcaattccgctgataaatccccccataaccggtgttgaaataaaatctacaatcctgccggcttttagaaaataaaacaacaacagccatagtccggttaaaagcgcaatcacaggcacatactgcattgcctctttgcttccactctcaatcccaagtgaaacaagtgcggctcccacaatcgctgccggtgcagcatctacaccaaagataaactgttttgaagtagaaaacagtgcaaagaataaaatcggaaagaccgaaccataaagtccataaactgccggaagtcctgcaatttgtgcatatcccatcgaaatcggaatcgacaccgctgccataataattcctgaaaaaatatctttttttaagtattcttttttataattttttaatgtcggaaataataaacccttcatacgtttcattccttattattttgccatttcatagattgccagcatatctgcctcatataatacttttgcagagcccttatgtccgcctgtatttaaactgcatttatgtgccagttcttttaattcttcttcactcggagtcagccccagctcacgaagattggtcggcatctttatttcacggaaaaatgcctccattgcttcaattccacgcatcgccatctcttctgcatctccggtatcttcaagtcccattacccgcactgcaaatttgtggaaacgctctggaatttctctatagacatatctggcccagcttccccaaagtgctgcaagtcctgctccatgtgccacatcatacataccgccaagttcatgttccagtgcatgtgttgcaaaatcatttccaccgtttccacatccggttaagccgttatgagaaagacttcctgcccacattacttcagctctggcattgtaatcttttggattttcttttaagatctttgtattttcaatcactgtacgcatcaatgcttcggcaatgctgtctgtcagctccatattttcccctttggtaaaataacgctccattgtatgcattaaaatgtcggtgcatccgcatgcagtctgataatccggcagcgtcatagtcagttccggattcataatcgcaaacttcggacggcagtattcactgtgatatccggttttaatccatccatcttcatttgtgataacagaagaatcactcatctcacttcctgttgctgaaatggttaaaataacaccgattggcagacagcctgccgcacttcttttatgagaataaaaatcccatacatcaccaccatttgcaactccatatccgattgcctttgcagagtcaatgacacttcctccgccgactgccaggataaaatcaacaccttcttttttgcatagttcaattccttcctttacaagcgaaagtcttggattcggaaccactccgcccagttctgtatatgcaaggttttctttttccaatgcctgttttacgcggtctaacaatcccgtccgttttacacttccacttccgtaatgaatcaaaacttttttacagttttgtgcctttacaagttctcctgtcttttcttctgtgtcttttccaaatactacctgtgtgggtgcataataattaaagtgaaacatcctctgatcctcctgttattttcttactttttgagttattataagtataatacctgtgttttcagaatacaagttgactttacatttctattgtgataatctttttacgatttaagtagaaacaatacgggagcttgtgtgacaggctgagaggaagatattagcttcgaccgcacctgatttggataataccagcgtaggaaatcataagaatttataattttaaccatatctgctccggatttccaaatccagggcatttttactttattcaaaaaatttttataaataaagaaaggatacgctttatgaaaacagaacattctcacttacttcgcatggttatgcttgccatgttagttgccatcggtgttgtcatctctccgattctaagaatcgaaggaatgtgtccgactgcacattttattaacattgtctgctccgtgcttcttggaccttggtattcccttctatgcgcaactttaatcggaatcatccgtatgatgatgatgggaattcctccgcttgccttaaccggagccgtatttggagcatttttatccggtgtcttttatcgggcttccggtggtaaaatcatctgcgctgtcttaggtgaaatctttggaaccggaattatcggttctctggtttcttaccctgttatggcaattcttatgggaagaggcggtttaaccgcattttactataccccaatgtttttagctgctacgacaatgggcggaacagttgcctggttcttcttaaaaaccttaagtcaggcaggtgttcttgccgagtttcaaagaaatcttggagcaaaagtttatgataaaaaagttagaaaatctaaaagaacaaaatcgactcactaaacccctgattcactgcattaccaatccaatttccatccatgactgtgcaaatattgttcttgcctccggcgcacgcccgattatggcagaacacccgcttgaagtcgctgaaattacaagcaccgcacaggttcttgctttaaatcttggaaatattaccgatgcaagaatggaagccatgccgattgcattaaagactgcggtacaaaaagaaattccggtgcttcttgaccttgtcggcactgcatgcagtacgcttcgaaaaaattttgcaaaagaattactggaaattcatgttccttctgttttaaagggaaatatgtcagaactgcttgccatgatagaggaagaatcccacgctgtcggaatcgacgccggagaaaaagattccatcaccgacgaaaatcgaaatagactgaccaaactctttcggaaaaaagccgatgaatggaatacagtttttctcatcaccggaaaagaagacatgattgtatcaaaatatgagtgtttctttgtccaaaatggttcacccgctatggcaaatattactggaaccggctgtatgcttgggatggtctgtgcttcctatcttgcttctgcctcaaatgcttttaacgctgctctgacttcgactgttgaatttggaattgccggagaactcgctgcgaaaaagacaatggctcctgggtcttttcaggttcagctattggattccttctatcagttgaccgaagcaaaacgagattcacttgcaaaaacaatcgtgtattaataaaaagaggagacttttggtctcctcgaataatgattacagctctattttccgatctttgaaataatattccttgtcatgctcattgatttctcttatcaccttacacggtattccataagcaaccacatttgccggaatatctttggttactacacttccggcaccaattactgtattgtctccaattgttactcccggcattacacagacaccgctcccaagccagcagtttcttccgatatgaattggcatattatactgataagcctgcttgcgaagttccggtaaaatcggatgtcccgctgtcgcaagtgtaacatttggtccaaacatggtataatctccaacatagatatgggtgtcatctactgcagtaaagttaaaatttgcatacacattatttccaaaatgaacatgacgaccaccaaagtttgcatgaaatggtggttcaatataacagttttcgccaagttccgcaaacatctcttttaacatctgctgacgtttttctccctctgacgggcgggtctgattaaactcatacaagcgttcctgacatttttcctgttcttttaagatttcctcgtcccctggaagatacaattctcctgtatgcatcttatctttcattgccataaaaaatctgtcctttcgtttatctgcttttattataagagaacggcatacaaaaaacaatttatttctcttttatttttctgctgttaaaatctcgcacagtgctccaaacattgccggctctaattccattgaagctaatgttgcaatcgctcctttttgctgttctttgataagattatacaaatctgattttaaattataagaaatctgtgctttttctaaaatctcataagcttcctgggcaaggtctgccaaactttcttcgactggattttcaaatactacttttatctctgcatttaccggcacttctgttatttctatacacataccatttttctctactgttgctttatatgccgtctcttttccatctaccagcacgcttactgtatttttcttcatttttacaaaatccaatttccagcatcgtttttctggaagtaccttggtatttccctgtggactgtgaatgataaagcagtctttcccttcttcctgtgctttttccagctttgtttctacccagctttcttctacacagtctccttcatcttcccataacgtaaaacttccagtctttccagggaaaatttttatttccaaagattttggattatccgtgtcattatcaaatacttccatatttttcagtggaacaattgcaccttctcttgccagtaccggaatttcttcgattccacggaacaactgaaccatacgtccaccctcatattttcttccattaaaaaagtcataccagactccggacggaagccatgtctttgcttttccaagctgagtttttgtatctattttctctgtaatcggagaaaccataagttcactgccaaaataataattattcggtacctgataagcttcttctctctccggctctaaataatacattggcataacaagcggtttgccctctttattggcacagtaattcatggtatacagatacggaacaagcgcatgtcgcagttttaagaacgctttcataacagattctacaatcttattatatttccatggctcttttccattaaacggattatccgtactatgcagacggttaatcggagaaaatacaccaagctgtacccatcttgcggtcagttcatcatcacgatatcccatcatatgacctccgatatcatgactccaccagccataaccaatattgctcgcatttgctgtaaaatacggctgaaactgaagactttcccaggtaatcaccgtatcccctgaaaatccaatcggataacggtggcttccaggtcctgcatatctggaaaatgtcagcggtcttgtgcctttccatttattatccagataatgataatgattgagcatccacaacgggtcaagtcccggaacttttgttaccgttccctgctgccagtctacccaccagaaatcaacaccctcttcttccatcggatgatgtaattcttcaaaatatacttccataaatttcgggtctgtcacatcaaacaataccggttctttcttttccggatccattcccatctttgttgcaactctctcataagcatcctcataagcacggattccatctgccggatgtacatttaatgtaattttcatgtgatgctcatgcagccatcccataaattccttcggatttgggaaaaatttcttattccaggtatagcctgtccagccacttccataaatcgggtctacatcatctaccagatgccagtccatatccacaaccgccacggaaaatggaatttcttctctttcaaaccgctcaattaattctttatattcggtttctgtatagcgatgataacgactccaccagtttccaaatgtatatcttggaagtaatggtgtctctccacataaataatagaaatctttcagacattccagataacggtgtccatatccaaagaaataaatatctttcttgtttccgactctaggctccactgttccatctgacttcaatgccattgtcttagaatcatcaattaaggaaaatccattttttgataaaattccatgttctaatggaatggctccatctgcttcatctaacgtacgagcagttccaagcaaatctcttggggcttctccataatgccacactctttcattggattttcctccggctacacgaatcattaagcctcccggagtaaactctttcttatcataatgaatttctaaatcttttgtgtaaatatgaagttcgccatttacatcacttactttaaattctgtcggtgcaaaatcacgattcactaccatctgtgtcggacggtcttcaaattctccattttcactatattctaagcgtactaacgcagtggtcaacattgaaattcgataatgttcaccgcttactacatttgccgcacagcacattggatttccatttaatacatatttttccaatcccattttcattcgctccttattatttaaacctttttcgtttaagtttattataatgcaattttttttaagatgctttcaaaaattttacttaaaactttactattttgacttttttattctattatatattttccagtcaactactcgtcacctaaaggcagtgagtttccacttgcaacacgcaaaaaattttttatttatgaatcaaaaaagagatttatacaaacgaatgtataaatcccttttctatctctcaatctatgtatttttcttactctacaatacgtctgactgcaatgtatggtctgtaaagcgcattagatgaatatttaattccgccctgtggatatggtttgctgttggaagcatgtacaattccgccgtctccggtaaggattgctacatgtccggaatatacaatgatatctccggcacgggattcagaataggtaattcctcttcctgaaccagcctgtgcatcactggtacgtggcaggctgtatccaaagtgtgcaaatacctgctgtacaaatccagaacagtcaattccgtttgttaagctgtttccaccatagacatacggatttccgataaactggcttgcataagaaacgactgcatctccacttgcactggaagtacttcctgaagaagttgtagtctcttcttcataagtttcatctactgtagtattttcttccggtacaattgttgtttcagttgttgtattagaagcacctgtattagaggactggcttccagaagcactgcttgtattagaagagctgttgctcttacttgtgcttgcagctttctttgcagcctctgcttttgctgctgcggcagcttctgcggctttcttcttagcagcttcttcggcagcttttgcttcagcggcttttcttgcctcttctgcttttcttgcttcttcttcctgtattttcttcagttctgcattctgctgttcaattaattttctatattcagcagcctgagcttttacttcagaaatctgattttcatagtcagaagctgttgcttttttcttttccagttcgttttccagattttcctgctgctcttcctgagcctgtttcatctgttctaactcgcctttttcttcttctaactgatttccaagagatgttacctgttctacaacatttttcattttagagagttcatctctgtcaaactgatacatcttttctgtgtactctgctttacttaataagtctgtgatattgctggactctaaaagcatctgtgcccatgcaccacttccaccattctcataaagatactgaattctttttttcatggctgcgtactgttcatcacgctctgcttcagattctgcaagtttttcttttgtttcttctatagaatcttctttatctgaaatctcaccttttaagatttcaatttctgccagtgtttttaccagactctggtcaagagaattaatttctcctaataattcttctttctgttgttccagttctgcttctttgctttccgctgcagataatttactttctgtatttgctttttcagtctgaacttcctcttttctggatgcagctaccggcataacctgtgtgactgcaagagcaaaaataagactgagacaaagaaatctttttttcatatatattatgtacctcacattttctttctgagacaatattaccttgaacatgatatcacaaaattattacattagcaagcataactttaaatttttgtaacaaataagaggtcctgtacaattttgtacaagaccccttttgtcttttgttcgctttttaattctcttaaagtaagattactctacaattcttctgattgctatgtatggacgatacagtgcgttagatgaatacttaattccaccctgtggatatggtgcactgttagaagcatgtacaattccaccgtctcctgtaagaattgctacatgtccggaatatacaatgatatctccggcacgggattcggaataagaaattcctcttcctgctcccgcctgagcatcgctgacacgtggtaaactgtatccaaagtgtgcaaatacctgctgtacaaatccagaacagtcaattccgtttgttaagctgtttccaccatagacatacggatttccaataaactggcttgcataagcaacaactgcttctccagttgcactggaagtactgcttgagctattatctgttgtactggagctgtcatcggatacatcttcagaataattgctgtcattatcggatgtatcgttagatgcatcatttgttgtgtcattagatgcatcatcatttgaagtatcttcagaaacattgctgttatctgttgtatcttcggaagcactgttactgctattgtctgttgtatcttcggaagcactgttactgctgttgtctgttgtatcttcggaaacattattgtcactgttatctgttgtatcttcggattttgtacttgtctgttctgcttttgtgctttcagctgctgctttttcttccgcagcttttgcttcggctgctgcctgttcttttgctgctttctctttcgctgctttttctgctgccgctttttctgcagcctttcttgcttcttctgctgctcttgcttcttcttcctgaatcttcttcagttctgcattctgctgttcaatcaggtttttgtattcctgagcctgagcctgtacatttgcaatctgagtttcgtaatcggaagcttctgctttcttctgatccatctgcgtctgcagagaactctgctggtcttcctgagcctgcttcatatcttcaagctctgctttttcctgtgtaagctgttctccaagctgtgtaacttctgttacaacatctttcatcttctgcagctcatcgcggtcatactgatacattttttcagtatactcggctttatcaaacatatccgtaatacttccggattccagaatcatctgtgcccaggcattactgccaccgttttcatacagatactgtattcttttcttcatagatgcatactgtttatctttctcagcctgtgcatcctctaatttctgttttgtatcttcaattgcagattccttgtcagaaatttctccgtttaagatttcaatctgagccatcgtctgtaccagactctgatccagagaatcaatttctccaagtaatgcatttttttctgattctaattcatcggccttactttctgccgcagataatttactttctgttgctgctttctcagcctgtacctcatcttttcttgctgctgcaactggaaaagtaagagatgctgacatcgctaaaactaagctaagagctataattcgttttttcacttctttacctctctcctttttttgtgcttcactgttgtccataatagcacacttcttttaaagatgcaagcttttttcattttttattaattttcatgttatattttgtaacattttattaatatttaactccttttcttgtgcttatttttttagacaaccttactcttttttgttgtcttcacaacgttttttatggtattataaactcatcataaaagggggttcttgcgtgaacataaaaaagaaattaaatgaaatcatctacacaatctcacgctacacggaaatatttctatctctcattattctgaccgtgattgttctactgattattcccgtcgtatatgattttgtacaacatcctctgcttgaaatcacggctcacgatttcaccacatttctggggaatgtcctcaccttactcatcggtgtagagtttgtaaaaatgcttgcaaaacacaccgccgaaacacttctcgaagtgctgatgtttgctcttgcacgacagatggtcgtcgttcacgaaacaatgatcgatacgcttatcggaatcgttgcgcttggagcaatttttgcaattcgtaagtatttattattgaaaactccggacaagcagaaaatttatgacaaactttaaaaagaatctcgcttgcgagattctccgcctgcggcggatcgcttttgcgacagatttcctcaccgccgcagtgcgctccctgcggagtgtttttatttcataggatgcaatttcctatgaaacaaaaagccaccctgccttagggtggttttttattcataagctctcattcccggaaacaaaatgccatctccgtcaggatgagattttgcccgcatctgtctttctgtcagcatataatactgatatcttcttccattttctctttctcgcaaatcccaggtaacgtcgcagaaaaagtgctggtctcctaatttgactacattccacgcatgagttttagaagcatagccaaaacattcgatctggagctgtcttagcaagtaaagaaatgttactgagattccttcgcagacaccgacacgattcaataatgtttctagcgtgtaagaagcataaggataagaattatcattctgatatttcttgtttgtatacgtcaaatttaaagtaagaaaatcatagacggcacgaaccatctctgcttccgtcattccttttgtaataatctgctccaaaatatcttttgccattgccgacatctgattcatttttcttcgaatcaaatctctgtcgttataatgataactcatttcaaaggaaaaaactgttccgtcttcattttgctgaacccgttttatttcatactgattccaatagaaaaattccggaaaatctaatgcaattgctaaaaagacggccgaccagtctctttttgtcataacggtgcatgggataacctctttttctaatctggaaatcgattttacgaactgccagtaaaactcctgctgtcttcctgttaactgattaacacagcgcaatgaagtgctgtgttccatcttatcaatttttacaatttcctctgtcattttttgctcctttcatcccctgtttttttaatataccaaatatgtactctcaaagtctttcctgcatttctttactccaaattcattttttcactccaagtttagcttaaatccaacatgacatctactttctgattcattcctttttctaatgcttttacctgaattttgtctgctgtttccataatcagttccacttcaatagtcgtgtattttgcaagtggttttttacttcttaagagacaggttccaacttcctgtgccccttccaatttcatttttgtactgatactgccacttgaatacagatgcagtgcaacttttgtctgtttctcataagcagtttttacgtttgttttaatatgtaccggaagctccatatttttgaaaatcaagttttcgacgtgataactttttgttcctgcaccagaaccatctaaaattctaagaccaagtgtctcattcgacacctgcttcattttcgggattttggaatgactacctgactgattttctgaataaatcaagcctttcataatccctttttccaacatgtaagcatagactgcatccccaagtgctacggcttcttttgatttgtaagagatacaattgtttccatacatctttttaaattcattcacaaagtatggatttacattacttccccctactaaaagagtcaggtctgcactcactcctttttctttttccacctttgccagacgttccaagacaggcattaattttacctgcatcaatttttcacaaagcttatggtaatctgcttttgagattccgatttcaacctgtttattatattttggagtgtaaagaataatactatcgtactcttttcctggggcagacatacggattttacattcttcacaacggtttcttaacacctgaaatgcctctttatccccagagagatcgattccattcgcttttaactgtgctgtaaaatacgccatcatcagataatcgatatcgtctcctcctgcttttactccgtccactgccagcactttaatctgacgttttgaggcagataacaaagccacatcaaatgtacctgcacccaaatcaatgattcttaaattgagcgatttctcagataacttgtctggatacagatatgcaagtgcacaagcctccggttctgtgatcataccagccaccttcattcctgcactctgcgctgctctgcgcacaaattccttttgttttagattaaaagaagccggataagaaacaacacatttatctgtacgataattcagttttccatcaggatccattctggtctttgtatttcttttcaagtactgaaataatactttatgagcgtccaaaatcgagaaacgtaccccttcacggctgattgcaaatccattattttccgtgccaatcaatgatttcatagataaaacaaccggctcaagcatggctctttccttggcactgcgtcccacatctgaaaattctaatggttctcttaagagaacagcagaaggggtgctgttcactccctcttcattttcaattactaaaggtttttcaattttcgtgttatagactcctactacgctgttattcgtaccaaagtcaattcctatcgttttcgctgcgtattcttcaaacatcgtcagtctcctcctgtatatttatatcctgccaccatttcttttaacaaaatctttccatgatattcataaccatttctaattgattttgcaattctggcatgtttctcttcttcctctgtctccacaatatcaattacttcatgaatttttgaatcaaaagcagaattttcctttgttgtatgaattttaacccccatctcttcgaaaatagagtcaagccgtttaaaaatcagatgactctgttcttcctgttcatttgcggtcagataagaggctacatcttctctccataaagcaagctctcttaaaaacttttcgaaatcttccccttctctctgcttcgcatttaaaagtccgataaattcctgcaatatttcactctgactttcgattttacgattctgtgagtctattttttcattcattttctttaacagattttccatctggcgatactggattcttttattcatcttcatcctcctctgtgttgtcaaacttagtcaagtggatattcgcaatccgcttcgctacttgctcataaccaaatagctgctacgcagcttatcagaaggggcttgccccctcctgatacaagcaagtccccacccctgcttattgcttttcgcaattgaagcaggggacttacttgatttggttaaaatgttccatatattcatcctggtttgcttttactaatttgtctcttttagacttctttaaagggattttcattgtattcaaatactcatccatcacaactttttcgtaatatttcatttttctctgttcttcttccattttgctcgataagaacttcattacttttgccatatcataaggtgccggcaataaaccatcttctttccacatcaaactataatactcatcttgatgatactcgtaagcaaataataataactttgcaaagcactgtgttttaccatcttctggctttccaatcaaagaaaccgcaatggaatatccaaacaatctttctcttaactcattctgaaactcaaaccattcatcctctttgtcctgataataattgcgaattttagagaataaaaaacttggatttgcgctgttttcaagatactcccagcattcttctgcaaattcttctggttttttatcctgtttcttatctgattctctggttttaatttctgttttctcctgaccagataatttatattcaaaagtttttgcttgtaaagaagtctgaatcattcctttttctcttaagagattccaaattttcggaaaataaattttcagcatattttcagcagctgtacattttttctcagggtttctataaatttcccatagattttcatacagcgtaaacaaaattttttctgtcactcctaacacatcttctccagcttcttttataatctgataagtaaactcataaattttctttcgctctttccaatccaatcctaaaactgtttttacggttcctggaatccacatagattcccatttcttttctccgtttttatattccgtttttcctccaattaaaatttgtgctttcgactgaaggcatgttccattactgatagtataaagatgttcctgaagctcataaggcagaatctgatagtactcaagctgtacttttcttcgttccggctctgatccttcaaatttaaaatagaaggattcttccggatgttttaccagataaaatgccattttaaaaagttctaatcgagtttctgtatttatcttttcaagtaaatcctcttccttccactgttcaaaccattttacatctctctcaaagttttcgtttggaagtctttttaaattttctttaaattctttctcataaaagaccattccgtttactgccggcagacgaaaaattatgttcttaaattcctcaatattcattaaaaagccgtgcattgtcacatgtgctcttccatcaaaataatttccattgactttctttccctgcataaccaccatatttttatttccaattggatagattaacaatgctttttctggactgtccacttcaatttcaagacattctttttcaattttttccagatattcgattggaaatccaggactgtagcgtaaaacaccaagtccatttccactttttgtatttctgcctccaataaagtaatacatacctttccctcccgatccctattctaccgttttcctaaacttcttctttaaaatttcctttatactgtcaaaatcaaataatccatctacatctgtttcatctgattcttcgtcttcttcataatctctttttgtctcttttttggtttcttttttagattcttcctttttttctgttgctgttggataaagacctgaatcattcaacaaatacataattggttcttcgataaactgaggattgtactcatacttccattccattccatctgattcactgattcgaaccggttcactgccaatggatgctaataaaccataaaccagtttgtcttctccgatataacggcggattgtattataaaagtccgggcagtcctgactcaaatactccttgattgccatctgcttcttattgaactcttttaagttgaaaccattcttgtgaaccagttttgtatatcttttgccatcccaggaaagtgtcttctgacaaatgcctgccagtttttcattctgttctaaaagcaaatctgctctggtaattgcaacaaaaattttataatcctgacccgtctttttaattttcacttttggaagaagctggtctaaaatttcatggtactttgcaacttcttttccgagcaattcatttgaatcaatcataaaaataatgtaagaagcatttaaaatagaagaattccaatccatgttgatacattcttctccggagatgtcatcgtattttaataaaatattacgttttggagcagaaatcatataataattcgccggataaataccgtttacctttgttccttccggcagtacctgctcataaataaaggctctgcgctcttcatcctgttttctttttagtaaatcgattgccggaaaatcatcatagattgctgtatcggttcccgatgcgatcaaatcaaaatacggcaggtctgtcatctggagacgcaggcaggtttttcctgaggacatacgaccaactgcaacgacctgttgcaccggcacacagcctgcatgaatcggaagaattttatcggtgccggcttttacttttatcggtgcaaatttctgtctgccatcttttaatttcttttttaatgcaattggaaattccgcatctaaatcttcatatactgcttcaattccgttttttccaaccatatctatgcttaaatatttattttcaatcacctggctttcctctaattcccagtcttcggaaagagtttctactccatttcttaattcttcattggtaaacaaaatttcggttttctttaactccacaccatccacttcaaatggaatataatctacctcatcactaatttttaatttttcaaacataaccgttcctcctctttcatgtactctcgaaacctattcttccgtaactaatcgattgatgatctctttcgcaattagtccggcattgacactgcttcccccattaatatgatttaaacataccgtaatcgaatatggtttattttcattcaaaatgcctcctgttacaagtaacgtctgtgtctttccgtctccttcttcaccggtaccggttttaaatgccgtctcaactccatcaactgcaaagtcacgtcctgttccttctctcatgactttcaccatcatgtttttgattctgtctgccacctcttctgtacacatctgtcttgtgactgcctgtgtctttgctttcattggttcttctcgtttgtcattcgagcctaaaataaaatgaggctctgccaggacacctttatttaagattgcatttgtatacatgtttaatccaatcgtggttacggatgcctgtccctgaccgatacatccgtagaccaggtcgtaagcattttcactttcccccataaaggtattatcattaaatttgaatgaaccaaaatgcatcacatcgtcaaatccgaatttttttaagttttttcttaaaatttcttccggaacctgctgcgctaaggcaataaaataaccattacagctctgcgccattgccaactccattgttgtcaatgttccatgtacatttccacctgagcagtgaacagaaaccgtttcttttccctctgcgtctaatgtaaaggtattgttgcctttgcaggtataactgaaatttgcaagttttgcatcgtattctaatgccgatgctgcaattgccagtttcatggtacttgccggatgaaattttcttgaaaatacggtttctgaagaatctcctcccagacataccgcagcctcaacctctccggtttgaaaattactcaccataacagagctgtccatatagccattttcaatcaacagatcttcaataaaattttgtaagtctgcgtcaatcgtaagctttacatttccaccaattcgtctctgatttggatgaaacaaagatttttcatccattcttgaatcggattcacccaaaagttccggtgccatcccaagaatggtcatgcggacatttccggtttccactgcctttatataatctgttcctccaattaaacgctccagagaattactctttttatcactcatccagctaagttttcctggttcactgccaaacatcaatacattatcctttttgtcataaatagtacctggcagatacacttctgaaagactcagtaaagaactgtctaattcctgttctgacattgtcgtttttgcatctgcttccagataacggtttcccaaaacaacagccagaacaagcatcattacaagtgccactttaaacaaacgccatacctgattaatgtaactttgaagtttttctttttttctgaacatttcttttttctcctttttccataaagccaagctccacagctatgtaacttacaaacattgcatttaaacataaccctcttgatgccagaggaaggctcactcctgcactgataaatcctcctgtattagacccaatatgaagcaaaagaatcgtaccggttacaataatgcttcctaacgtccaaaattcttccattgtatctaaagttcggatggttgtcatccatcttacaagcaaaactcctgctgcaatgaccagtattcccattaaaattccgtaatcataaaggattcgtgtcaatgcatgatccgtatcacaagtcgttttaaaaataattgataagtttccaggtcccaatccaaaccagccactacgctgaatatttttcaaaaaataaacaatactttctgtctttccaaccagtgcttcgtcggttactgctttcggtaaatcaagccatacttccagtcgcactctgatatgagaaacaaacctgcaggccaaaaatgctgttccaagacagagcccgatgtaagccatccggatttttaaatccggaatcgaataccagaaaaacgctgttccaagcagagcaattagaattaataaattaaattcgttgcacattgctatgagaggaaagagagctacggtataacctaagaaaccaacatttttggaagaaagactcccaacctttcctccaagatatcctctgctgtgccctttcaaaaaccagcagatagcagtttgataaagcagaacaaccagcggtaaaatcaaaattccaaagaccttaatgtgtgctccgtttatcggattacaaaacagcgcgccgattaatgccaaaggtgcagaaagcatagccagaaagcccagattctttgactgataccagttagtataacaagtaagaacataaaaacctgtaaaaaccaaaatcaaatactttaaatcgtttgcaaaaactctgcagtttgatgcacaataggaaacggctgccccgatattcattaaaaacaacatgatgtaaattccctgtcgtttctttcgattcttttcccatataatactgattacgagttctactgctaacagtattgtaactacccatacataagccaggctctcatctaatgatttcttattgctgaatacagtccagaaaagcaatgaaaaagaactgataaaataaactaatttttcaagcattaatcttcctcccttctgaaatcgattttaattccatccataaaaagtgttgtatttcgtgtgatatgtttctgtatggaagcattctcttttaaaacagtcccctccatttcgacttccccctttaaaacagtcaataaaattttgttttttgattctatattcaaataaagttttactttactcttacatccgtaaattctgatatcgttaaaccaccctgttccaagtcgataaataccaggctgaagtgaaagttcagataccatatctttattttttaaaaagcgtttcattcttccgattcgcttaattctcagactccatattcctggaactttataaactgttttctgcattgtcgcactttcataacaaatgaaaatcaaaaaacagatgaccgttatcatttctaatgtgatgtttgtgattctcacttcgtttgcctccttccttttataaaaatctcgcttgcaagattctctgcctgcggcgggtcgcttttgcgacagctttcctcaccgcccggtacaatcctcgcaaagcgtttttaaattcataggatgaagttccctatgaatttaaaaagagcatttctgtataatttaactatacaaaaatgctcttgaatttcgtttctaattttatttttttattgctttttattctttccagaagcaatcataaaagatttttacttctcccttccagttttccgacatgtttctctcttcattgatatgataatgtcctgcgtaccaggcttttatggaagaaccaaatcgttcaaggatttcatccattttttcttctgtccgtgatgtctgttttcgttctgtaaatacttttgcacaacttttcggaagcacatgagaaagtacaattaagtttaataagtctaaatctttttgattcttctcttctaacctgacaataattttctgccattctatctttgaaagttcttcatccggccaccagccttcgttatttaacattctcgaaaaataatccgaggaatatccaccaccgagtaccagatactgactgccttcgattttaaataattctccatcttttaaaaaaatcagattaggatattcagattccacatagacttgtccaccccatcgcatctgcttttcataagaataaatgttttccggtctgcactcatgatttcctcgaatcaataaaatattacattctttttgattcttttgccaaaattcatccactgctttttgaagctcttgcttcttttttctgtccccttctcctaaatcatagttgattcctgcatctccatgcacaaacagataacagttttcttttccttgatttttttgaataaattcaatgatacgactcatgttcccgtgtaaatctccggtatgtactctcatcttcaaatgcctccttctattctctatatatcaaattttataaagaaggttctgaattttgagttaattctcacattttacctgattcaacaatcgttcatcaatttctattgttttattctttaatttttcttttaatgcatctaaaatcacttgcggatgcgcgcctttttgctgtaatgtttttaagatttccaaatcttttcttacttcatctgcagtccggtattcttcttttccattttttttcatcatttcaagcagcttttcagccacgctttcactgcatccggttcgttcctgaatcttttctatgttaacacttccatctcctttataaacctctccatatagaagccggaacataacctgaatacagctgtaaaggtctgtagctggcgtaattgcttttactgcttcaagaagcaatccggcacgtcttgctgttcgctcttctatatatctcgcttttgcaacactaagctgaaaaattttcggagctcgatatccctcactgctgcatccaattccttcgttaaatacaatcttatctgccatctccttcttttcctgccggctcatggtctttaaatcatatccatattcgtcataagaaaatacactcccgaaatcaagcaggcaaaatgattttgccacgccctctccacgaatccagatattctgccctttaatatccccgtgacagtatttatctcccaaaagctgttctacaatcactaaaagccgttcgattgattcaatcgcttcttcgatgctaagccgtcctttttctctgacataagcttctaatgtctgcccttctgaagtatccagaatcatataactgctgtccccgtaatgcgttaaaaattccgtatgaaatgcataaggactgttattttttccatcaaaatacatctcatttgccaaacgaatttctcgtctgacattttgttcctgacgtttcttttcttcttcacgatcctctgagcgaatgcaaatcggctctcctgctttttcccgataataacgtttcacaggtgactgactttcatctggaaaatattcttttatgatacacatctgtttttctccattgaaatgccggattcctttataagcaatcgctgtgcctcccctgcccactacctgaatcaagtctactttcaacactccgcttttttcatccgccagtgtaattttttgtttttcatcaatcagactctgtctctccattcttttactcccattttttattcctattttttcctcttacttagcatttagcaaataaaatatcatgaaaaactgcatagccctcttccagacagctatcttcaaaatcccatgaagccattcttaaccgattaactctttcttttaaagaacacatttcttccatactttcaaagacttctataaaatattcatcaaacggtgtgtccaaaagttccgttccaaatctgcaattaaataataaattttcatttatgtatggaagctgaatatttgctactccaagcgctttaattccaagtactacaagcagtaaaaattctcttgaaacctctctttctccagtcagaatttccttaaaaatcacttccattctacggagttcataaggtttttcttctgcatccattccatgtctgaccgctcttgcttcaaatggtgcaaatgcctctcctttttccaaatcttccttaatttcatcttcttctaagccatctattacataatcattaaataccaaacctccgtcaaacaactcattgaatacgtgaatgactttcgtataatttaatctccggctcatcagatattctttccatttttctgatgaaacctctttatactcgtcaatgtattctgctattttcgataacggacgccccatttcattcgtttttccaagcccaatatccgtcaaccagcactctttgagttccttctttaactgctctttcatcgaagcatccgtctgccaaatttgaatatctctacaaaatttttcaatctgccctattacaacaagggataataaacggtataaataccactgtctccgttttccggtatcacatacatgcaaaatcacttcctgattaaacacttcttccagcttcgtttttccaagtctggtcggatccgcaataattccattcatattttctgtaatgatatccagcgaattttttgtttccattccggtttcatccagtccagctttgattctctcacaaacttctttgaaattttttgttgtcagattatccatttcaaaattcaatgcatacgctgtttctttccgttccttccaatctttcgataagcctgcccaaatatcaaatccctgatgtgtttttaagacataatacaaaattagttctgtcatatcacttttattatccatacgcattaacgcatacttgcaccccgctgattcacagatatcttcataaagttccagataggattcttctttatcaatatttagctcattttcaatcacaacaaacatcagagtcatacactctaactcggagagctttctctcttctacttgctctcccgattcttctgcttttaaatcctttataaactgtgtaataaatttctgacgcaattttttatgtccatttaaatattcaaattccaattctccaatctgctttatcatttcttttgacgtttttactgtctctttggcttcccatttttctattgaatacggataatctgttatttcagcaacgcacttcaacacttctctatacatctttatcttctcctgtcttttttattctaaaaccttctctcagaaaattgtttataaatactcctctatcttagttcgatattctttcactaattcttgcagttctgtccacgcttctaattcctctaattttttctgcaaatctttcaaaacaccaacattcattcttctgtttgacacagctaattcaactacacgctcgatctgtactggcagttcttctaagatttgtttttccagattttcttctttcttttcttttaacagacaaagttcacagccaattgcccgcactaaaaataacgcatccggctgtgtcttttttactgcttcccgataagtttcatatcctttttcatattgtttcatgcaaaaataatcactcataatcgtccggtaactgtccatcactctgtcaggaagagaaatcttacgaaactccaacgcttttttatgccattttaaagcttcttcatactcttttctctgataataatagcttcccatattcgaaataatttttccgtaagtcaacttatattcttcctgctttttttgatattgcggcacattttccagttcttttattgcggcttctaatagcggatacgcatccctcttcttctctttattacaacaataatataaaaaattataacaagtcccttgttctaatggcgttaactttattttttgcatttcctctactgcaatccagccaatttccacacacttctgattctcacttaagtcttcatgaagtcctgcaagctcataataaaattcaaaggcttctttttttacttcgtcctcttctgctaaaaagcaatacaattctgctccaagctctccataaatgaattccgcaaaatcaaggtgacggcatcttctgctaaattgggctgctttatcaaacttaggataatattttaaattttttattaccaaatctataacttcttttctattctttgtctccagaaatgcacacaaagccagatattctctaattgtttcatgcgaaaattcaagctgctcatctacgattcccagctttggaaggatttgataaatcaatgccttcgtcatattctgcggaattattgtctcactcaaaacttgttccaataagctttgatattccaaagttctgagcttgttttcttccgaatccacatttatccaaagcaacgctttctctacttccaatgctatcttcggtaaaatctcatgaattaaaaagcgtcggatctcacgaatattatcacgatgcgcttccattgaatctgctaaaacatctagctcaaaatatttttgaagcaactcatttctactttttaaccgcatcgcttcttccggtgcacgctcataaatctctcgaaaaagttttaaaaacattgggttttctaactcttcttttaaatggatttccggtgccacccattgtgtaggactcagctttaaatacgcatcaatttgtgttttctccagcttttcaaattcaatctttttaaatttttcttgaatcgaagggtcataaaacgaaaattctcttctgcttgtcataatgatatttacatttgaaaaagaactaagctcccgaatttcattttccaggcactcgtataccatcattccattttccagacaataatctactaattcattcactccatctaataaaaacaagaacaaatactcagatgattctcttaacatcttgcataccacatctgtccgtaccgcctccttaaaaaacgcacataattcatccagcaaaaagtttcctcgaatccgttttcgattccagacattcatcttgaaatacaacggaattactgttttattgttgagcattgcccctgtcagttctcgctctaataataaaagcgatgttgtttttccggttcctccagatccacataaaatataattttcaggataagtttgataaaattccaataaattcaaatggttcaccagctttcgtaaataagtatatctagacttattatagcaaaaaaagccagcactcaaaagcaactctgggattaattctggaaagaaccttttcctgccttgaaattttattcttgctggcattaattacgataaagaaacaaaacatcacagttgttccattaaaaaaattgatcattctaatttttagcatattaaaagagatggtttttcaaccatctctttttcctctgaactcacttttctcgttttaatttttttctcataactccgccaactaatacacctgctcctgaagttttttcgtggttggttttttcgtcaacaaccgagaattcccgccctaattcttaaaccttcttcatgcaaaaaaactccccgccatctggcgaggagttttccacatcttattttacattctattcaattacaattacagtttcagattaactccgatttcattcatatttttcagaattgcatctaccgcagcctgcacttcttcgcttgtcagtgttcttgtatcaagaccaaaggacaaacgaatggttacactcttcactcctgctgcatcatagatatcaataaccgaaacttctcttaagatttcaagttctaatttcttccagcactcagaaatcgtatcaaagcgtaccccttctggaatcagtaaggataaatcatattcaatcgtcggatatttggatggttcattgaactctaagtccatagccggaattgcaagtaatacatccatatcaatttcaatgcataccactgccgcatttttcgcaatatgagccaaagtctttggatgcagtgtattcaaaataccgatttcttttccgtctaccaaaatctttgttgtattcttcggatgctgccattcatgtcttacttctgttttttcataagccacttttttatgtttcagctgacttacaatggtatttaaaagctgcactgctttaatatataatttcttttcgctttcttctttactgtacatcgcgattccgagcatgcgatgttcatcggcagtctcatcttctcttactcctaatacggtacgcgcaatttcaaacattccaaagcttggtttgtaattacggttattgtataccaatggcaggaagctctgcatcatgctggttcttaagattccattgtcgtctgcatgacctaaaagacgtacattttcttccggagcaagtccaagatttctaagagcatccggatcacaccataatctggtattgacttcattcattgcataagcttttaccagtaagtctttaatcagattttcttcttttctgcgttctgttgtctttgcaggaagcagcggagataaggttgtcttgatttcaaagttatcatatccatagatacgtgtaatttcttcaataatgtcggctctcatgctgacatcttttgttcctctccagcttggcacttctgatacgaagttttcgccgtcctgtgtggtcttaaatccaagctgttccagtgttaatttaattctttcacatggaatatcaattccggtataacgatctacgaattttttgtcaaactctacttttaattccggatattttttcacatacacatctgtaatcttacttgcacattcacattccgggtctacgtcttttaaaagcttgatgaaacgttttacggcaagcattgtcatttccggatcaagtgtcttttcataacgtgcagatgcatcggtacgaagtgctaatctggaagccgatttacgaacacttaccccgtcaaagtttgcggattccaatacaacagaggttgttccgtctacgatttcactgtctaaaccacccatgattccggcaactgcaaccggtgtttcattatcataaatcatcaaggtatccggtgtaatttcacgttctacatcatccaatgttttgaactggaaggattcttttggcgtgtcaactacaatcttttcgattttatttccgtcaaatgcatgcattggctgaccaagttctaacataatgtagttagttaagtctgcaagcagattgattgctcttgtaccacagtagaacagacgaatctgcatttccattgaactgacttttttggttacattttcaatgcgcatgcttgtgtaacggaataccaggtctttgtttgctacttctactgcaacagttgcatcacctgtgtatggattttccattacatcaagtggttttacatgctggttggtcagtgctgcaaactcacgagccattccataatgtccccataagtccggtctgtttgttaaagatttattatcgacttcaaataccacgtcgtcgattgggaaaatttcttttaaatctgtaccgttctttaagtctgcatctaattccatgattccgtcatgtgtctcagaaattcccagttcttttgcagaacaacacataccgaaagatttatatccacgaattttggaagctttgattttgattccgcaaacttctccgcctactttacaaaatgcggtttttaaacctgctcttgcattcggggctccacatactacatcgtaaacttcatctccggcatccacttttaataaatgcagatgatcggaatccggatggtcttcgcaggaaagaatttcaccaacaacaacatcttttacatcttttcctttatattcaattccttctacttctgctgtagaaagtgtaaatctgtgaatcagctggtctaaatcccatccgtccaaatttacaaagtctttaatccaattcattgatacgaacatgtttcttcacctcctatttacttacgaactgtgacaatgcatttaagtcaccttcgttaaatacacgaatatcttttacgccatatttcatcattgccagacgggtcagacccagaccaaacgcaaatccggtatatttatctggttcttcttcggtgttaattcctgcgtattttaatacgtttggatgaatcataccacatggacacagttccagccatccggagtttttacaggatgggcatccgtcaccgccacagattaagcactggatatctaattcaaatccaggttccacaaatgggaaaaatccaggacgcagacgtacttttacatctctttcaaagatttcagaaagcatggttttcataaaataaatcaggtttgaaatagagatgtctttatcaatcataattccttccatctggaagaaagtgttttcatggcaggcatcgattgcttcatttctgaaacatcttcctgggaatacggcacgaatcggacgtccttcttcttttaatgcttttgcatacttcttcataattgcattctgtgcagcggaagtatggctctttaataactggtttggtgtagacagataataggtatcctgcatatcacgtgccggatgatatttcggaatattcagtgcttcaaagcaatgataatcatctacgatttcactataatcttctacattaaatcccatagattcaaagatatcctctaattctctctgaatcagagtaattggatgataagaaccacacggattttctgtcggaagagattcatcgtaggactctgcctgattgatggctctttcttcttccagacgaatcagttctttttctttttcttcaaattttgcaattacttcctgtttaaatgtattgattaactgtcctgttgtctttttctgttccggcggaacttttccaagctctttcattaagcctgaaacatacccttttttacttaaaaaatttcggcgaagttcttctaaagaagaagatgcatttacggttccaagttcatcttgaaactgttctctcagtttttgaatcttgtctttcataatttcctccataaattaaaaattcaagcacgcttctcatttattgaaataaaaaaacctcgccccacaaaaagggacgaggtatctcgcgttaccaccctaattcaaaaccgctgtttttttattatttctattctttctcttatacggttttgctctcatctggctttaatgcagccttacatctgacttaacgctgaacttttacagcttttcgccagaagctcccgtgctgaaattcgatttctgatgtttttgcttctgcttacagccggtgacaaaagctctctggaaaaacaagttcaaaaatctacttacacacattcttcgctttaaaaattctaacatacttttttttaaaaatcaataagaaacagccgaattattttttaataagccagctgtttctcttatctttttattcttttactccacctaaagttaatccggttacaaaatatttctgtaagaatggataaatacaaataattggaagcattgtgataatcgtagccgctgcacgaaccgaagtaggtgtaaccgctccaattgcatttttcatcgcttctgccgaaccaccctgatttgttacagacgacaacagtttcatcaattcgtattgaagtgttgtcagactactattcatacggttatacagcattgcatcaaaccaggaattccactgtccaactgctacaaacagtgcaacggttgcatacactggtttgcataacggagaatagatttttaagaaaatcgtggtatatcctgcaccgtctaactgcgcagattcttccagactattcgggattccgttcatatatgtacgaattaccaacatattaaatgcacttaccattccaggaattacatataccgcaaaactattggtaagtccaagtcctttatataacaggaaagtcggaatcattccaccatttacatacattgtaatgacccagaataaagaaagtcctcttttaaacaaaaaacgttttctactaataataaatgcaagaattgcattcgataccaaagccagtactgttccaataatcgttcttgatacggtaatataagcacctgtaagcagattatctttttgtaatacggtaatatagtttttccatgtaaattttcttggccaaaggtaaattcctccacgaagtgcatctgtaccatcatttaatgaaattgccaatgtatttaataccggatataatgtaataattacaagcaaaatcataatgattgcatttacaattggaaacacttgtattttcttttttgctttttttgtctcttccattgtcaaattcctcctgattagaataactgttcctcaccattatgttttgcaatctggtttgcaattacaatcaaaatgatactaacagcacttttaaagatacctgccgctgtaccaattgcataatcaccctgactgataccccattttaacacgtaaatatcgattgtctgagatacactctgtaccaggccatttcctaaaagatactgaatttcaaaacctgcatttaatacattacctacattcataagaagcagaataataattgtaggtttaattcccggcaatgtgacgtatttaattttttcccatcttcctgcaccatcaatggaagcggcttcatataaagacgggtcaatagatgtaatagccgccagataaataattgcattccatccagtttctttccatacatttgcaaacgctacaatcggccagaaatattttgtatgtgcgaaaaagttaatcggcttactaatcagatgaagatttacaagtaactcatttataattccggttcccgaaagcatatcatgtaaaatacctgttacaataatccaggaaaggaaatgtggaaggtaagaaattgtctgtacgactttctttccaccttttgatttgatttcgtttagtaaaacagcaaatgcaattgctgtaaaaaatgtaaccacaagattaattacacccatggccagcgtatttcgaattacgcgaataaatgtcatatctgaaaacagcatccggaatttttctaatcctacaaattcagaatgaagaattcctgttcttggcttataattctggaatgccattgcccatcctccaagtggaagatagtaaaagataattccatagattaccattactgctgcccaaaacaatagtactttctgacgttttatttctttccatgtgattttatttttattttcttttctcgattttgtttttaccattgccataacatcactccttaaaaaacaggcagatgaaattttatgctacatctgcctgcctttaaatttcattatttaaattgtgctgcctgttccattcttctgtctaattctgtttgtaattcactaataaaatcttccggtttacaatcgctatatgctttcatatattcgctccatgcaccgtcaaaatcttttgccattacaacctgtggcagtttttcatgtttcaattctccaatttttgtccatgctacaccaccgtcggtatctgttgtaaagttattggaataactccacattggataccagtctccaggtgcatcatttgtaccaagcatctctacataagtttctgctccatacgcctcaaatgcttctttgatatcatcatttaagcctgagaaaaattcacttgcctgtccatctggtttatttgcatttattccatcttcacttgttcctgtatactgtggtaagtaagaataactgcacatatgtgatgctttatacgcagtatcggatacctgcattctttcttccggagttctgtaaaattctccgttctcatctacttcatagtctttaccctctacgccccagaaacgtaagttatgtacttcttgtgaaagtaaatcattcacaaactgtaatgcaccttctacatcctcacagcttgttgtaatcgcaagtccacttgatgcattaaatgctccaccggcattatgccactggttatcacgcccatcaattgtaacaggaaccggaatataatcacagccctgcttatccagtccggcttgtttaattgcatcatttgcatttaaaaaatcccaccactggtcaatcattccaagtacacgtcctgaagaaagttttgagatatattcgtcatagctctgagtaaatgattccgggtctacaattccttttttatactcctcatttaactttccaaaatatgcttttgcagtatctgttgtattgtaatccataactttctgagtttcagggtctaccatacaagaaccatcatttggatatccatccaagaacattggagcattttccagacagaaatatctccagtcatcgcataaaatagtatacggaatattttctgttccatcttccattgtaggatttgcttcattataagactctatcagattaaaatagtcatccattgttttaatttctggatagttagcccattttaatactcttgcctgaatccaaaatgcttcatcattatgagtacagactttttcttcacctttgatgcagctaaactgtggtatccagtaaatatgaccatcttcctgtcttaatttttcccattcaaggtctgtaaataaatttttaatattcggatagtcatccagataatcatctaatggaacaagcgcttctgcatcatataactgttgtgttccatttcctccctcaataaaatccggatactctcctcctgcaatcattgttccaattgcttctacatccgtctgtcctgtcagccaagtttcttttacttttgctccagtcttttctgcaatcagttcctgaatctcattatcatcattaatttccgaacccggaactgcaaaaaaggcagtaaactcttttactcctccttcatctgaacttgatttactttttccactgccgccgcatccagtaaataatgtggcagccaataccgtgcctatcagtacacttgcaactacttttcttctcatactgtaagtacctcctttttgatatatttattatacttgtttcactttttacaaaccagctgagaaattatagtcaaaaacaggataaattatagtttttctttatttgttctataatttatcctgctttttattattcttcaaacatttgttttctaaatcttgccggagtgcagcctttcacctgaataaatcgattcacaaaataatccaggtcatgatatcctacttcctccgcaatttgtataattttcttatctgtatggatgagctgattcgatgcttgctcaatccgataattatttaaataatctttaaaagactgtccatatttctttctaaataactgccccagatatgcactatttacataatatttttcacttagcccttttaaagtaagattagaagcaaaactctcacgaatttctttttctaccataccaagaactcctcttgaaacattctttctaagttgaaaaaggtactctgcatattcacatgcaaaacttgcaagatgcgctttacttcctcgcataattccactttcaaaactgctctcactgattaatcttaaaatttcctgttgattcacatcatcatcctgctcgcttgcaagatgaatcaagcgaaataaaagataattgatgttaagcgtcatggtctcactgttcattcccatatttcccatttcctggtaaaataactcaattgccttttttatttctatataattattttgctcgattgtcccaatcaaccggtccagactttctttacacaatacaatcttattacaggatacctgcacctcatcttcgtaaaagtaaatggatttttgcgcccgaaatccctgaaaggaccgaagcatacaggtatttccataagactttgaaatactgttgatatctgaaaccttctttccaaccaacattatcagtggctgtttcatattatttaccagatattgataaaacttttccagataagctctttcatctaatcctaatttttgcgccatcccatctgcaaaaatcagaccaatatcatatattttttcattcgcagatacatcaaacacacaatggtttgcatcttcttttaaaaattcaatgcagcactgatataattctctttgaaaatttctcatatctttttctatactttcatccatttcctcggattgtgctttttgaatttcaacataacgaactccctctatattcttcatatgttgttttacatattccaaattgaaatcatcatattttccatgaatcagtgcaattacatttctggaaaagtaagctttttcctgctcttttcgctttttatccaattctctatcctgacttcgcattgtataaactttttccagtaacttaagtaacatttcacggtcgataggctttaaaagatattccgtacactcattttgcattgccctcctcgcatactcaaaatcggcatagccgcttaaaatcacaaaataagcattggataatttttctctttttatggtttctaaaagttcaagtcctgtcatctctggcattcgaatatctgcaataattaaatctacttcttcttgttctaaaaatgcaattgcctctttcccatttgcagccatccctgcaatttcaaatccctcctgttcccagtcaatgagcatttttattccttgcagaataaatggttcatcatccactaatagtactcttaacacttaattttcctcctcatacatattcagcaggtatctgaatcataaccatggttcctaccccttcttctccttcaatcgtaaatttcactttatcatctgaaactattttcagtcttaaacaagcattaatcacccctactcttccttttactttcagcatttcaatacttgcattttgcattttattttgtaaatcctgatactcattttcgctcattccattccctgtatcttctatttcaatatataaattttcgtttttttcatagattcttacaaaaatccatcccggagaggatttactttcaattccatgtacacatgcattttctacaaatgtgaccagagtaagttttggtataattttcttctcacattttggacttatatttatatcataatttaatcgctctccaaatctatatttttgaagtgccaaatatgcttttacaaattcaatttcctgttctatttccacacagtctgctccccactctacatactgtctttgcattaatgcaagtttttctaccatatctgccgtttcattttcttgttttaaaatactatgcatccggatgctttcaagcgcattaaataaaaaatgaggatttatctgactgtgcaatgcaagtaactctgcattttttcttcctactataatctcttgttctctgattttacttttatacaccgtttcaattaaatgattcgttctctctaccatacgattatagttgcgaatcatacttccaatttcatcttttccccgttcatctgacatataaatcagttgttcattatttacggactgaaatactttacttaattttgtaatccttttggtaaaagaacgattgattaaataaacaaataaaaccggaagtattacatttacaaaaataagtaataatataatctggaatttattcataagactatcccacccggttttctcactttcatctatacggatttcaagttctgtcccgtaaagatttacctcctgacaataagtgtatttactccttttctttactttttcataattttcactttccgttccatgctttttattggaaagcacaattcttccctcatttaaaatttcaacttcattatcataattcattttctttagttcatcgcttacttttccataatccaactctacttttaatattttttctttattcggtgaatagaaatctaatttctgcaagaaaacaatctgccttttttttgatattttgtttctgctctcatcatatacgaaaaaaatccctttgctttttttctgttcgactaagctttgatacgcttttgtttctctgatattttcaatcttatttacctttcctccatttactatcgtttcattatctatgtaaaaagtaaatactaaattattcattcctaatatattttcaagtaaatggtccttgaaaaactcctgataagtcaacacatattccggagcactttcatattcttgcatcaaaaacgaattgatatatttactggtataaatactttttgctgtttcccctatgctgcttatcgtattactgatattatagcttactgcatttgcaatatttgccatctcatgttgttgtttttcctgttctgaacttctaacaatgaaaaagataacactatccgtgataataatggggattaaaacgcatatgagataaagcatgtataatttttttttaatttttaagttatccatcccttcttctatccgatgcaataattttctcattttcttctttctcctgcttttttctaaaaccacttcagggagcagaaaaattctgctccctagtcaaaaatcctatatctaatcaatccatatttttcaaataaaaccaaccaaaatccgcataattctcactttgttttccatttgaagacgcatacattcctaccgtacaccctacaaatcctcctgcctcttctgttgtatacgcagtaagaggaatcttttctgcaaccggtttaaggtttttctcttttccaatccatactctggcttcctggtcatgacattgaatcataatttttaaaattccctgccacttactaatatcaactattgaaagttttgtctcttccccatgaatataagagtttacttcaaatacttttttcccttctacctgttttatttcaaactttaaatgattttcatggttctgatacaaaatcactcctgctgtttcattttctgccttcggttcaaattcaatccctgtttccacctcaaaacgataacttttttgtcttaatcccaaataggaactgtagtctttttctgaaattttctcttttctacagtataatcgtaacattccttttctctctgaaagagaataaatttcttcatctcgtttttcgattcctactagtctttcatctaactcattttcccaaaactgaatacaatctgaagaagtcacttcatttgcaaaacgatgttcttcaagcggaatctcaacaaaatcttcaagccgtccaacttgtggggcgataaccggccatccgttttcccagataactttcgccaaaaaagtctctcttcccatgctgctatgttttttacacggtcttgatgcaagcattactacataccagtttccatatccatcatccacaaggtctccatgtcccgcatagacaaccgggtaatccattcccagatttctgtgtgtaaaaatcgggtttctaggacagccttcaaaccactgaaatagttttttacttcttgctacactaatgctatgttctggtcctgttccaccttctgcatgcattagataataatactctccaatcttataaatatgaggtccttccggccagatgactccctttacagcccctttccagattgccatactctcgccgaccagtttcatactctttaaatcaagttcctgaacccagatttcccagtctccgttgtagcgtaccccttccggattcggccttgtgccacaatagtaacacctaccatcatcgtcaaaaaacagacttgggtcaattcctattgcttcttctcctaaataatatggttctgaccatggtccttccggattctttgcagtaacaataaagttccctccatagcttacgtttgttgtaatcatgtagaaaagcccttcatgatagcgaatcgtcggagcaaaaatccctctcgaaatttcgcttttttcaacttgaagctgctctttgctttctaaaatatttccaatctgctcccagtgtgctaaatctctactatgaaaaatcggaactccaggtgcatatacaaaactagagtttacgatataaaaatcattccccactctacaaatagatgggtctggataaaatccacttaaaattggattctttgcaattaccatacttcttctcctcctatttcacatatccgaatccaagaattgtaaaacatttctctctttcttcctttggaatctctattcggacaatatgttctttcgtttctttttcattgaataaaatgaccgcattacaatgaagccagttattgatatgtgggtctgcacacaggcaatattctgtgtctacccaaacatctgcttttcccacatttgtttctcctgaatctttaaatatcaataataacgccttacagcttattttcatctcaaagtatgcattttccggcgaatctccattatacatccaattatgcggaaactctggcactgtcattaaagaatcatcgatttctacacattgcaattctttatcacaatgtacaaatcctccctcatcaatcttcgcacctacataactatcttttttatctatcaggtggactgactcgaaactatttccaatgacaggtgtttccagaagccttctctctaatgtttcctcatcaaagattcctgttacaaatttattttttcttaatccctttgtttcttcacatcgttcaaaaaaatagctaagacaatctgccataatggtatgtcccaaattgctcggatgaaacatatcatagaaaaactgattcttcgttatactttgtttttctttgtttttaaactgaggcactactgcatcttttatgctgaccattggcaaatcatatcttaatccaacaggcatcaaacgttcttgaagattccagtcatttgcaaacactgaaaacagcaaaataactgccggtttccatggaagcttcaaagctttacgtacaaggctttcataacagtctccctttgtttcatctccttcatcattcactgcaaattcaatgacaatgatatccggctgttcattttctcttaatacatctctttcaaaccgtaacattccaagctccgatggagttcctcctacacctgcttttatgaattttacattttcttttattgcaaattttttctgaaacatcttccacgatttatacgcataacactccgtatggatcggcgttgctcctgctccctgggtaatagaacctccaatgtatgctaaagtaacaggcttgcctgattttgctttttggattgctttttgtatccggaaagtattccccatacttaacaatgagctgcgaaccatttgactgtactgctctgaattaatatttacggtttcatcttctatttgttctggggcatcatatccatcgtttaaataaagttttacacttgcttttcccattatttccggagtttgaaatataaattttatctgtcccggaatattatcgtcttctgtccattgatattctgacaacaaaatcttatattccattccatcgccttttaatttcgtttttaggtttgttcctcctccatagaggtcattctttccatatatctgaaatataaattctatttcttcttccggattctctgtttctacaaaaattccgatactatggaccagttttccaaacccttctactgtctctaaaagctttaactcctctttatctgtaacattacctgctatctgtgcgctatttattaatcgtccatcactctcataaatatattgaattcctgttccatcctcctgtctggaactaaaaatttctttttctctcataatataaaaatacggtctttttttctctggatttttcggtgcttttggaccttgcatctttctttctccccagtctcattcttaatttcatttattataacagactacactctttagaacaccgggagaaattatagaaaaaactccgacaaaatattacgttttattcgaatcctaattattaataaattcgatagtttccagacaaagcaagcattgaaaacatataaaggaaattatcataatatcttctgtctcctgtgcgaagcggtgtattccagaatttctctacacattcttttgcatacggaccatttgctgccaaagatgcctgagcattcgttgcaataattgccaccggatgcaatgctttctcttctagtcttgttccatctgttaaaaatactccatcccaatgtagcttctggtcctcacagtaaaatttctgaagatgattcgcattttctacctgccaggaatctactccaaaccactcataatccagtccgatatttgcaatcgttcgataagcatcactataataccaatcatgacgtccaaaaatctcctgatgccctttatgaggagttccatcataatccgcatattccgccgataaacctgtttttgggtgacatgctttatgaagatagtcgcgacttgcctttgctgcctctttccaaaattctctatcctcgggatttgcccattttgcaaataattcataaaaatgagggagatgataagatgggtcactaaaatcacagtttggaataaatttaatcaaatggtttttcgcatcccacatagaatcacccggttgccccggttcgcctttatgtacacattcttttaagattgcccttgcctctttactatactcaaaaattccttctccgtcaccccatcttctccacgcaaagaataaagacatcgcaaaaaattcttctccatccggagccggtccatctgaattccaagttccatcagtgccacacgaccatgcaaaataattttttccaggtcctttcggaatatacatataagtacgaacccatttccaaagacggtcaaattcttcttttctattcatctgtacacacaccatcattgcataagacattccttctgttcggacatcgtgatttcctgtgtcttccacatacgccatgtcttctccgacttcatggtaaaagcgttcttcttctgttccataaaaaatagtctcaaaggtcttctctactctctcttgaatttcctctttagaatatccgcactccaaaaatacatttcgatattttcctgtctgataagctgctgtcattttttatctcctcatactatattattttctctgaattttttcaattataacaaattccatctcatctaataccgggaataattatagaaaaacctccgacaaaatattaagattctttcattgataggtccctttagtttaaaaaactctccactttttttccatctctttcttgcgaatagatatgcaaaaattgcggagtttcttttttcttttaataaaaataaccaatagacatgaaaaaatcgagatatccacaatctttcttcatgcctattggtctactattctaattcacatcttctctttataatatttttctttcaagcaaatatttttttatttcttttgtgaattcatatattatatcttgcactccaagtggcataaaatcatctcctttccgtatcagaaaccgtacgttttttatatttttattatatagtgtttgtatttccagatcaatgtccttaatccctgatacaaaaagcacaaaaaatcccccagagttactgcccaagcagtttctccagggaattttagctatccaatcaaaaatggtatcacatacgccacaagtacgattactaccgcacatgcaaccacaatgctccatattttaaattctttatccatttttttcttttcttccggacttggtatttcttcttcaatgactcctgacaaatcttcctgtacttcatttttatatttacttctgcagactgcataaattacaagtccaagtgcgcaccagataattcctgttatcattgcttctttatctaattgagtcatcataatcaaataaataataatactgattggcgctcctatcataattccaggtgctttaaacggacgtttgagttccggatgtctttttcttaaacataatgatgcagtaattccgatgacgtagtaaaacaaatctgcaaacaaactcaaagaagcaatgtaaatcatagaatttgatgcaatcaaaaatgccgaaagcagtccaagcacgataatggatacataaggagtctgatattttgggtgtacttttgcaaagatttttggcattgcgccatctcgtgacattgtaaataaatatctcggcggaactgcaatacttgcatttaaagtagaaaaatctccaccaaaggcaattccggctgccaagagtaccagcggaaatccaagaattccggccgttttcattgcttctgcaaacggtgcagacgcagttgccaatgaagaaatctctgaaatcggtacgattccgactaagaaccactgaaatgcagagtttactgcaaatacaataaatggtgccagaatcagagcgcgtggaatattaatctgcggatatttgatttcttctcccattgcacagcaggtttcaaatcctgcaaaacaccaccaaatcatactgaccgaagcaataaagctaagtggtgttgattttgcaatgaaatccggcatctgtacaaagttcggcatatttacatttggaagcatcattaagaaccagataattgccacaccccagaagaagaacataaatccattctgaagttttccggtcatttcaattcctcgcacatttgttacaataaataccagaacaatcagtgtcgctacaacggtatcactgactggaagttcaattccaagtgcagagaaaaacgttttaaaataaaaactaaatgccagtgcttctccacttgttaccgataccagtgaaataataaagttccaaccagccagcattccaaacggttttccaattccgagggaagcatattggtaggttcctccggcatacggaagtgcggctcccatctctgcatataataaagatggataaatgctgattaacattgcaactaaggttgccagtataaccgccggtcctaaatcaccaactacattggctcccgtcgtaaacagtccaactccgacaacggttccaactgtaatggtcacggcttctctcatcccaaatgttcgctttagcgtttttttcttttcctcactcatatctcaagcccctcttacttttatttttgtaaagcggacattcgcaatccgcttcgctacttgctcatgaacgcagtcgcttcgcaatctgccagtgtgagctttcaactcccactggcataagcatcccttctctcctgcctcttagtgctctgcgcacttgaagcgggggaatgcttatctgcgttcaaatagtataagttatttccgaatatctgctgccgctttgtgtcccattaacccttctccatcagccagtcttgataccagcggagccaattttttcgatgcttctgctgtcatactctgctgagtacaggtctttaagaaggttccaacccacacaccaccggtatagcgtgcggcttttaaagtcggaagggtgtgattggtaccggatgcatagtccccaaagacttctgcggtattttctccgataaacatcgaaccatagttgacaaatccttcaataacttcttctggatttttcaagtttaactctaagtgttccggtgcataatcattgactaaatccactgcctcttggatatcatccacgactacgacttctccgtaagttttccaggattttcttgcaatctctgcggtttcaagtacctgaagttctgcttctacagcttcaatgactgcttttccaaatgtttcatcggttgtaactaacattccttttgcattgacatcgtgttcggactgtgcaaggaggtcggctgctacaactgccggtgttccgctgccatctgcaatcacaagcacttcacttggtcctgcgacaaaatcaattccaacttgtccatagcactgcctttttgcttctgtcacaaaacggttacctggacctacaatcatatcaactggtgcaatctcttctgttccataagaaaatgctgcgattgcctgagcaccgccgactgcataaatttcatctacccctgcaatatccattgcaacaagtgtcttcggattgatttttcctttacctttcataactggcgaacaggctgccacacgtttgactcccgctacctttgccggaataatcaacatcaatgcggtagaatacagtggataatttccacctggtacataacaacagcaggaattaaccggaataattctgtgtccgagaaagattcccggcatcggactgaagttttccagtggttttacggtctctctctgcgctttcgcaaaggcacggatattagaagcggctgcttttaaatctgcgatttcttcttctgataactgtgcatacgcttcttcaatttcgtctttcgaaacacggatttgttctctctcgcacgcatcaaattttcttccatattcctttaatgcctcatccttgtttgctcttacattatcaatgatatcctgtaccagacgggataattctcttctgtcttcttctgttctttcctgtgatttctttaaaactctcataactaaaaacctctctatcttttatgataaattacttttcttattctctatgctactatattaaagcgtctagtttactttaggtcaatatagaattttctcattttttcttcaaaacatggagtatactccatattttcattgatttttttactccaaactactacactacaaatacaaataatttttatgtgaggaatttttatgcgaattggaaaagtttcaaaagaatatcatatctccatcgataatctgcattactatattaagtatggacttcttgttcccccaaagccaaagggacagtatttctttgatgagaccacgttaaaagacttagaatggattcttgctctaaaaaaattagatttctctcttcgggaaattcattcgattttgtctctgaaacgaatctcaaattttgcagatgctgaagatttagaagaactaaaagaattattcaaaagtaaacgggacttctgccagcaagaaatccagaaaaaagaagcggttataaaaaatttagatgctcatatcttacgcatggagcaggcaaaaagaaaagaaaaaagtccaactggtgttcctgttaaagccctttccattttatgttgtccaaaatgtggtgcttctttttccatgcaggatgtggaaatggaccagcgttttttatataaaggagcactgtcctgtaaatgcggttattatgccaaaatttcttctggaattttaatgacaccaaacaaaaatcaaaatctgcaggacacacctgatttgactcgcgagctttataaagatttgccacccgatttaatcagcatgttcgagcgttcttataattggatgttagaaaaaatgaaccaagtcaatcttcatggaaaaatcattgcagaaacttatatcaatgcctggttttttatgcacaatcacttgcaggcgcttccaacagacagcctttacattgtcattgataaatatccggaaacccttttaatgtataaacatttaattgaaaaacaaaagccggaactcgacattttatatattgccgattctagcacgaactttccgttaaaaaaacactgcattgatttacatctggatttctttgctgcaaatgaacataacttttatcatgatacctttttatataaaagaatcattccatttttaaaagaaaatgctgacctgattggaacttatttttatttttctcatgcacaaaaatccatgcgaaccctgctttcccagtatcctgaatgtagtgcaaataatttttctctttcttattttaaaaactcacttgcagaatctggctttatcttaaaagactgtgaacctttagatgctgtaactgattctggaaacaatcttggatttggttttcatcaaaaaggagaaaaaatgtatctgatgccttattatgctcaaaaaaccggccagtagtttctgaccggtttttctttccatccatatttttttcattcttaagcgaaaaacttccctgctgcctgaatcagataccaggtatctttaattccggcagtctcatacggagagtgcattgcaagctgtggaagtccgatatcaactgcatttaacgcaacttttgttgttgagatatttccaagagtagatcctcctaagatatctgaacgattcgtaaatacctgatatggtacatctgcttttttgcagatatctttaaacattgctgctgaaaccgcatccgtacaatatttctggtttgcagaatatttaattacaattccttcattcagatatggacggtttaccggatccgccacatcactgtaatttggatgaacggcatgtgcattatctgcggataacataaagctctttgcaagatttctgacataatcttcataagaatattccatacattcattgattcttaccagtacatcatacaggaaagtagacgctgctccctgttttgttccactgccgacttcttcattgtctaatacacagtgtacggccagatgtgcttttttctcaccttttaagaatcctttcaaagaagcaaacgcacactgtaagtcatccagtctggaagaagaaacaaactcttcctttgctccccagattgttccttttacacgattgtataggaataaatcatgtgctaagatatcatcttcctttactcctgctgtttctgcaattgttttcataaatgtatctttagaatcaatatctccgtaaagcggaagcatatctttctgtgcattgtatttataaccgtcatttacttcacgattcatatggattgccagatttggaagcatcaataaatcccggtctacatttaccagttttgtgacaaattcatcgttttcgtttacaataattcttccggctaccgaaagtggacgatcgaaccatggagaacaaatcattccaccataacgttctacatttaattttacatattttttatctacctgcatttccggattttctttaattttaaaagttggagaatcgctatgacttgccatgattcggtaacctgaaaattcgtcttccggcattacaaatgcaatgatagaagaatcatttcttgtcacataatactttccacctttttttaattcccatttatctgcttctttgatttcttcaaatccttccatatcaagcatatctttcatggtttttacagcatgaaagcaactcgggcttttttcaataaattcaagtaattcttttgctgtttctttatacattttttcttcctcctggaaatcagaaaagccatgaaacttccctgcaaattcctgcacacagcaagactttcacgcagaaatctcatggctttccgtaaataaaatttattttttatttgtacgtcttgcaatcatcggcatgataaagccaagtccaattagtacaaatggtgttacaatatttaagataagctggaatctgtcttcggaatagatacccataatacatgcaaatgctgtaaataagaagcaccatccaccaaatatcataccaactgtcttattctttacaaaatgatactgagccgggaatttatctcctgcttttttcagtgcaatatatgctacaaatacccaaagataacggagtggcatacaaacagagtttacttttaccagccagcgaaccagtgtatccacactgtcaataccaaatgccggtacaataatcagaatggaaacgattaccataactagtttatgtccatttgtgtaagtaccatattcattttgtttaaacattgcttttggaatataattttcatctgcacaatccagcagcatacgaagcggtgcatcaattgaaataatcaataccgtaaactgtccgattaagttacagattgcatataccactacaaagaagttgcccaatccataatactgacctaatgtctggaatgcgtaataagcaccatttgtcataaggtcttccggaatattattggaatcaaacatcatacccattgcgattgttccaagcattgcgcacacagcaaccataattgccagtgcaatcatacccttcgggaaatctcttgctgggtcttttgtcttattaacatatggagaaattttctcacatccacctactgcgaacaccagaatggataaatttaataaaaacttcatatcaaaagatggcatgaatgttttcatagaccagtcaatatctaacacatttgcatttgtaatcgccggtgctgccatcatcattacgatgaataatagggacatgataaacatcgtagagcctgccaacgtagacagtttctttaatacattgatgcctcttgacgctacccatattgcaaataagaacagtaccagacatgcaatctgaagcacttttgtatttacagaactaatacggttatctctaaaaattgcccaactagctgcgataaaagatgcatttggcttctgagaaatgtacggcatatgtacaacccaatatgtccaacctgcaaaataagcaactttcggaccaattgtctcatgcacccaagaactcacaccaccacctgcatctttgaatgcacttcccaattcaccaaccataagtgcatatggcacaaagtaaatcgcaaagataatcacccacgaaataattgcttttaagccgccatactcagaaaaaccattgatgacattaccaaatgcccaaactgtggagaatgccataaaagcaagactgtaccaaagaatttttttgtcacttccaccttgtttcattgttactttccctttctttaactatactttgctattctgtttttaataacaacagtttcaatacaacataaataattatacattcaaagctgtcaaaaaagtgacaaactttcctacttttcgtcaagaagttccatggcaatcttttccggtttaatcggcatctcttctacacgaagaccgactgcattgtaaaccgcattggcgattgccggacacggagtatcaattacaatttccccgattgattttgcaccgaacggatgactcttttcataactcggcttaaattcaacccgaatttttccaacatcgagacgacttggaatcttatactgcataagagaattattcgccattgcacctttctcagtatactggatatcttcaaataacgccataccaattccctgtgcaattcctccttcggtctgcactctcgccaaatttggattaatcggtgtaccacagtctactactgcaacataatcaatcaattctacacttccggtttctttatcaatctcaacttccgccattcctaccatgtaaggcggcggtgaaatctcagcggcacagttttctgtcacctgaagtgcatcattatttccaaatgttccccgaactccgatttccggaagggttacttttgccgatttgtctttcttttctacacattttccatcaaaagttacttcattcggttctgcttctaacatggaagctcccatttttacaattttttctcttaagttctcagctgcttttgccactgcttttcctgtgatataggttgtagaagaagcgtaggaaccagaatcataaggggaaatatcggtatctacaccaaatggaacaacattgttcaaatctgttcctaaaatatctgctgccatctgtgacaaaatcgtatcacagccggttcccatatcggttgcaccaagtcccaacgtataagaaccatcctcatttaattttaaagttgcaccaccaacgtcaactttgaaaattgcagaaccctgcattgccatagctacgccaacacctctaacttttccatttggaagttcttttctcggatacttttcatcccagccaatcatttctttggcacgttccatacattgatccaaagtacagcttgtagcagtcggagaaccatcataagcaataaatggatccccttcacgaatcatatttttctcacgaatcacagtcggatccatacccatcttttctgccagttcactaactgcggattccagcgcaaagattccctgtgttgccccataaccacgataagcacctgctgccatacgatttgtatacacaacatcatatccaaaacgatatgcctctgtatttcgatataaaccaattgacttatgtccggataaagcaaccgttgtcggtccatgttctccaaatgcaccagtattcgataaagtaaataaatcaattgccagaatttttccttcttcatctgcaccgacttttacttttacttccatttcatgacgcggagacgaacaaatctgagattcataacgagtgtacaccaattttgccggtcttccggttttaattgtcacaattgccggataaacttctgttaccagggtctgcttcgctccgaaaccgccaccaatacgtggtttaattacacgcactttagaagcgccaattccaagcgcacgacctaaaattcttcttacatggaatggaacctgcgtggaagaaacaattacaagacgtccaaaatgttccagataagtataactgcggaaagtttccatcattgcctgctgatttgcttttgtatgataagttttctctacaacgtatttacatttcgcaaatgtttcttcaagatttcccattccttcttcagaagaagcacagagatttcgtttattatctgcaccaaccgggaatctggattcccagttatcttccggatgaattaaaattttattatcttttgcatcatgaaaatctaaaatagcatccaatacctgatattttacttttatgattttaagcgccttatcaactgccgcttctgtctctccagccacaatcgctaccgcatctcccacaaaacgcactctctggtctaaaatcagacggtcatacggactaaattccggataagtctgacctgccattgtaaaacgatcctgtggtacatctttataggtaagaatgcaagcgattccaggtactttcattgctgcatctgttttaatttcttcgattaacgcatgcgcatgcggacttcttaaaagtttaacaatcagacagtccttcggtgcaaggtcatctgtgtagaccggctgtccggttaccaatgcttctgcatctttttttctgactccgctatttacatatttcattaggcttctcctttctctgcttttttatgttccagaaattttaaaatacttctggtttgtcccataaatccagaacaacggcacaggttgccagccagatattcgttaatctgctcttctgtcggattctccagttcttttaacattgcaaagatattcataataaatcccggattacaaaagccacactgttctgcaccttcgtctgctaaaaagccaccaaactctttggcttcttcctgcattccttctaacgttacaatctttttgccatccgctctggctgcaagcatactacaagataagaccggcttttcgtccataagtaccgtgcacagtccacagtttgcggtttcacaacctctttttacactataacaccctttttgtcttaataaatctaataataataaatccggtgcgatttcttcctgtactttttttccgtttaaaaagaaattaattttcatttgcatctccttccacctgtacaagtgctctctttgtcagtacctttactaaatggcttcggtattcggcagatgctctcatattgctgccggtcggaaccagtttctgcacttcttctgccagtgcctctacttcttctactttaaatttaaaagaagattctaactctttttcaatcaacattgctttttgaggtcttgctccaattacgattctgactttcttttcttctaatccaactgcacaagtcagcactggaaaatcagtcgctgaatttctctgacttaaatacaccgtatgcatcggtactttttttacaataatgcgtaccagaatatccctgtctttcttcatctgggcaaattccttcattggaataattccacccttataaagttctacataagaatccatcgccagaaacatagtcagtacatcggaaaaaccatatctcccaaaaatacttccaccaactgttgcacagttacggaactgaactcctacgatatgtcttacactttcacacattgctccatttgtataatcagccagtcctttatgaagctccagactgcgaagcgaagtcatacaaccgattctaaattcattttcatcttcctcaatagtatcaagacctaaaccggataaatcaatcgccatgcttacatttcgatttcccatctttaaccagaccataccgccgataagacaggctgttcttttctgatttaactgatatgcctcttcgagactttctacctttgtatactcttttattttcagcataataatcctttccataaaattatttgagtcatttgattttatacaggaaaaaagagtctgaaattcagactctctcccaagtaacattgtcagtaaccttgttcttcttttatgagtatagcatagcaaatggcacaaatgcaacccagtttttttaacattttcagtcattgacatttttcgtaaatcctatacaatatacaatagggtataaaaggaggataacttgagtgttaaaaaataaaaaacagatattactaattggattttctgtcttattgctgcttattgttttgattttcgctttgacttttaaaacttcagccgaaaaagaacgtgaggaacaagcttctcttgatgcggtctctgcatctattgatggaactgttacagcaattacaggaaaaacgattactatttcaacatccgatggtgattctattacttttaatatgcaaaaagtagaactcgactgcaacagcggtgttattccgggaaacaatgtaactttgatttatgtaggtgcacgtaatggaacagataccagtaacgtacggctgagaaaaatcattacaaccgatgataactcagaccttttatcagcaaaactcaaacagacagaagaggaagaccaagaagaggaagacacaacttccacttccagttctccaggatatgataaaccaggagcagatgtcgatgttgaattgacaaaagaaaatgttactgctctttacaatgtaaatgtccgtgcagacgccgacggagatgcacaggtcattggagcacttgacccagatacaactgtaacaagaaccggtatctgcagtaatggctggagccgtatcgaatatgaaggtcagactggttatgtgtggggtgaatatttagaagcggatgaatctgattcttcctcaaattcatcttcatctgatagctcaagcagttctgattccaaaaaaagcagtagttcaagttctaaaaaatcaaagaaatcaagctcatctaatgagtaatacaaaaagaagctcaagaacaatcatcgttcaagagcttcttttttattcatctaaaactataaaatttcaattccagctttttcacaagcttctaatgtatgttcatcccagatacttgcctgtacttcacctacatgtgctttctgaagcagaagcatacagattctggactgaccgataccaccaccgattgtcagcggaagttcattatttaacagcattttatggaaagtcagatttcttctttcatcacatcctgcttttgttagctgttcatccagagtttttgcatctacacggatacccatagaagatacctctaacgcacactgaagcggttcatgccagaataataaatctccgtttaatttccagtcatcgtagtccggtgctcttccatcgtgacgttctccggattttaataaatcaccaatctgcatgatgaatacagtttttttctctttgacgaaagcattttctctttcctttggagtcagattcggatataaatcttccaattcctgggaggtaataaaagtgatgtctctacaaagttctgtatgcagattttcatactgatattttacttcgtctaatgcattacagatagattctacaatacgtgtaaccgtatttttcagataatccatatttctgtcttctgctgtgatgattttttcccagtcccactggtctacataagcagaatgtaaattatctaattcttcatctcttctgattgcgttcatatcacaaagaattccttttccaggatggaaattatagcggtataaagccatacgtttccactttgcaagagaatgtaccacctgtgcttccatctttgcatctggaatatcaaatgtgactggtctttccacaccatttaaatcatcattcaatccagacgccgggtctacgaataaaggtgctgttactctttttaattttaacgccatgcagagttttttctgcatcagatttttaatcataccgattgcttcctgtgtctcataagttgaaaggcaggatttataaccttctggtattattactgttcccattctattgtcctccacttttccaagaatgttatcattttagtacaaaatacaattcttgtaaagacaatagggacggcgttttccgattttttatgttagccatattaatattgcacttattattaaaatagcagccacaattaacgaattttttcttctatttgattcaccgtaatctcttaccaatacacacgctcccgcactaatactcattaataatattacgcgctttcggattattggatttatttctcctactgcaatcatgccaatggcaattagcaccaaaatccacgtaagatttcttaaatatttgtaccctctaatatccattagatcactccaatcaaatctgtacgagctgcattactgtaaaaataatatttgtgatacatacgtggtcttccacccactaactcatctgtataataggtaatatccgtataataaacagttggaagagaacgacttattattacatttgcaatagtaattgccgctgctgctccagcagagccaacaactgctacaatcgcagctacaaccgctgccgtatcacttaaatctgcatttaatgtaccatttctacgtgataattcatgagaagcatataagctgattcctacttcagaatttccaatattttttccatctaatattaagttaccactttgtttattataatcaattacgtgctcaactccatttttgttatagctaactcttctcaaaatttcattttcatatatattatacgttatttcttcactatctattttagtttctattgattcatcaaaaatcaaatcattttcggcttttacaggaaaaacagctacatttacaattgatatgatagcaattaaacaaatactcaaaattttcttagctaattttctcatataattccttcttatatatctaaaatagttttttataataatattatactgttcattggaccttcctcctttttctttatatttgtttaatcttttcgtattttctgatattttatcatttgtaatatttttttctttattttaatattttttattgtttttttcaatcttttattatataaatattatctttttataaaaaatacacaaatataaattatccctcttaggcagttttacatacaaaaaaagaaccctttcggattcttcttcatgtttttcttaaacatgtaccttcaaaactacatatacaaaaccgaaaccatgcagacacttgccgctccactgatttctcagtttctggtcaagccctcgaccgattagtagcagtcagctccatacattgctgcacttccacctctgccctatctacctcgtcgtcttcaaggggtcttacttcctaagaatgggatatctcatcttgaggggggcttcacgcttagatgccttcagcgtttatcccttccaggcttggctactctgccatgcagttggcactacaacagatacaccagcggcctgtccatcccggtcctctcgtactaaggacagctcctctcaaatatcctacgcccacgccggatagggaccgaactgtctcacgacgttctgaacccagctcgcgtaccgctttaatgggcgaacagcccaacccttgggacctactacagccccaggatgcgatgagccgacatcgaggtgccaaaccactccgtcgatgtgaactcttgggagtgataagcctgttatccccagggtagcttttatccgttgagcgatggcattcccacttaataccaccggatcactaagccctactttcgtacctgctccacccgtcggtgtcgcagtcaagctcccttctgcctttgcactcttcgaatggtttccgtccattctgagggaacctttgggcgcctccgataccctttcggaggcgaccgccccagtcaaactccccgcctggcattgtcccaccgccgggtcacggcggctggttagaaacccaatactgcaagggtggtatcccaacatcgactccgtagcaactggcgtcactacctcacagtctcccacctatcctgtacatgcaataccgaatcccagtaccaaactggagtaaagctccatggggtctttccgtcctggcgcaggtaaccagcatcttcactggtacttcaatttcaccggatgcattgccgagacagcgctcaaatcattacgcctttcgtgcgggtcggaacttacccgacaaggaatttcgctaccttaggaccgttatagttacggccgccgtttactggggcttaaattcaatgcttcgtttcctgacatctcctcttaaccttccagcaccgggcaggcgtcagcccatatacctcacctttcggtttcgcatagacctgtgtttttgctaaacagttgcttgagcctattctctgcggcccgcttttacacgggcaccccttctcccgaagttacggggtcattttgccgagttccttggcaatgcttcttccgtcggccttaggattctctcctcatccacctgtgtcggtttacggtacgggtacgttacaaacaatagcggcttttcttgacgcatggctcacacacttccctactctaattcggtccgcatcacgcctttggattgccacacggtttttcctatgtgactcctccttcgcttgccccgggattccattcccgggttgtgctctccacacgtgtccccacagttctgttctaacgcagtacaggaatctcaacctgttgtccatcggctacgtctttcgacctcgccttaggtcccgacttacccagggcagatcagctttaccctggaaaccttagatattcggccataaggattctcaccttattctcgctactcattccggcattctctcttcaatacagtccacagctcctttcggtactgcttcttcccgtattcaatgctcctctaccaatgtattactacattcctcagcttcggtgtcgtgttttagccccggacattttcggcgcaggacctctcgaccagtgagctattacgcactctttgaatgtatggctgcttctgagccaacatcctggttgtcttcgaaatcccacatccttttccacttaacacgtactttgggaccttagctggaggtctgggctctttcccttttgactatccaacttatctcgtatagtctgactcccgataatcaattccatggcattcggagtttgatattcttcggtaggctttgacgccccctaggaaattcagtgctctacctccatgtatctctatcgaggctagccctaaagctatttcgaggagaaccagctatctccgggttcgattggaatttctcccctatccacacctcatccccacccttttcaacggatgtgggttcggtcctccactgcctcttacggcagcttcaacctggacatggatagatcacccggtttcgggtctgcacatactgactctggccctattcagacttggtttccctacggctccacgcctttggcgcttaaccttgccagcatgcacaactcgccggaccgttctacaaaaagtacgcggttccgcatataaagcggttccacagcttgtaaacacagggtttcaggttctctttcactcccctcccggggtccttttcacctttccttcacagtactatgctctatcggtcactaaggagtatttagccttacggggtggtccccgctccttcccacaaggtttctcgtgtctcgtggtactctggatcctgccttgtcctctttcctttcccatacggggctttcaccctctctggctggctttcccaaaaccattctggtagaatcaaggaatcaattccgcagtccgaaccccagcatgcacgcacactggtttgggctctttcccgttcgctcgccgctacttaggaaatcgagttttctttcttctcctcggggtacttagatgtttcagttcccccggttcccctccatacgttatggattggcgtatggatacatgaggtcttctcatgtgggtttccccattcagacatctccggctcattggatatttgctcctccccgaagcttttcgcagcttatcacgtctttcatcggctcttagtgccaaggcatccaccctgcgctctttcttgcttggccattcagatcttatagcgttaacatctgacggctggtgttgcttggtttgtttctatttcttcgctgtatttctacagcgcctcgtttcgtctctatcttacgttttacgtattttagatgtttcgtatatgcagttttcaaggtacattcagatgtaagtttttgtaatgccatgaccggtagaactttgttctggaggttgcgagcatcacactcactcttattcatcttttggctgttttatcagccattcaaacacaaaagctttttatgcttgaatcactggtaaaatcaccatttgcttattttattttttgtaatccggcagccacctgctttcccatgccgtctccagcatagtatcatcggccgcttaagtcttaaccatcgtgttcgggatgggaacgggtgtctcccctaagcgcatcgccaccggaaatgtttggttattaaattttagaagttttccttccttaataactcaacagtgaaacacttcttaactacttcttcttccttagaaaggaggtgatccagccgcaccttccgatacggctaccttgttacgacttcaccccagttatcaatcccgccttcggcagctccctccctaaggttgggtcactgacttcgggcgttactgactcccatggtgtgacgggcggtgtgtacaagacccgggaacgtattcaccgcgacattctgattcgcgattactagcgattccagcttcgtgcagtcgagttgcagactgcagtccgaactgggacgttatttttgggatttgctccccctcgcgggctcgcttccctttgtttacgccattgtagcacgtgtgtagcccaaatcataaggggcatgatgatttgacgtcgtccccgccttcctccaggttatccctggcagtctcatcagagtgcccagctctacctgctggctactgacaataggggttgcgctcgttgcgggacttaacccaacatctcacgacacgagctgacgacaaccatgcaccacctgtcttctctgtcccgaaggaaaggttccattacgaaccggtcagatcgatgtcaagacttggtaaggttcttcgcgttgcttcgaattaaaccacatgctccaccgcttgtgcgggtccccgtcaattcctttgagtttcattcttgcgaacgtactccccaggtggaatacttattgcgtttgctgcggcaccgaagagctttgctccccaacacctagtattcatcgtttacggcgtggactaccagggtatctaatcctgtttgctccccacgctttcgagcctcaacgtcagttaccgtccagtaagccgccttcgccgctggtgttcctcctaatatctacgcatttcaccgctacactaggaattccgcttacctctccggcactcaagaaaaacagtttccaatgcagtcctggggttaagccccagcctttcacatcagacttgctcttccgtctacgctccctttacacccagtaaatccggataacgcttgccccctacgtattaccgcggctgctggcacgtagttagccggggcttcttagtcaggtaccgtcattttcttccctgctgatagaagtttacataccgagatacttcttccttcacgcggcgtcgctgcatcagggtttcccccattgtgcaatattccccactgctgcctcccgtaggagtctgggccgtgtctcagtcccaatgtggccgttcaccctctcaggccggctactgatcgtcgccttggtgggccgttacccctccaactagctaatcagacgcgggtccatctcataccaccggagtttttcacactgtaccatgcggtactgtgcgcttatgcggtattagcagccgtttccaactgttatccccctgtatgaggcaggttacccacgcgttactcacccgtccgccgctcagtcccttacatcttcccccgaaggttctgtcgtaagcgcttcgctcgacttgcatgtgttaagcacgccgccagcgttcatcctgagccaggatcaaactctctgatatagtgtttgtccaagttcaagataactacttggctatctatcccttttactgttttggttcattgaaccgttctttttaaaataaatgaatgtaaaagaattttcgttttcatgtgtttcactgttcagttatcaaggttcctgtcgttctttttatcagcgacagcttctatattatatcaaagctgtttttgtttgtcaagaacttttttaacttttttcaaagttttttgttgctttcgaactttttaactttttgttgcttttatttcagcaactcgtttatattatcatcttttcagttatttgtcaacaactttttttatttactgataatatagtcaaagttctgtattttctctgtcacttatcagcgacaactctgatactatatcacagttgcacaccatctgtcaacatattttttatatttttttacacaaaaagaaactcttaaaaatggaaacgcatttttaagagtttcttctattattatagtatattagtttttgcttatcagcctttaataccagactgagcaacaccctcaataaactgtttctggaacaggaagaagattacaactaacggcactaccgctagtactgctcctgccatctgcattggatactcggtggtatactgtccctgtaaggttgacagtgccggtccaagtgtcattttttccattgaggtgtttacaatcaacggccacataaagtcattccatgcgaacttgattgtaaagattgcaagcgctacgatacctggttttaccagcggaagcataatctgtccaaagacacggaatcgtccgcatccgtctacaattgctgcttcttccagttcttttggtaatgacatgaagaactgtcttaaaaggaaggtaccaaatgcactaaataagtttggcataaacaatgcaggaatcgtatccagtaatcccattttctgaataatctgatactgcggaatcaagaaaatctgtcccggtaccataagtaccgataagattaatacaaacagtgcatttttgaacggaaagtcaatacgtgcaaacgcatagcctgccatcgaacaaaatgcgatctgtacaagtgtcgtaaccgctgtagaaataatcgtattcatataaactgttccaaatggaatcgcagaggatacaattgtatgatatgcagtcgttacaaagttttccgggaaaattgtcggcggaatcttcatcgcttctccggatgttttaaacgaagttaaaatcatccataagaatggaaatactacaacagcaactccagcaagaagaatcagatggacaatcaaatgatttaagtttgattttttggttttcattctcattctcctccttcttaatcataatttacccattttttctgtccaatcatctggattacagtaaccagcatgattgccaggaaaataaggattgaaattgcggctgcgtatcccttatgaccatagtcaaacgcctgtcgatagaacagcataacaaccgtttgcgttgattcataagctggatttgcttttccgaccatcatatataccgtatcaaatacctggaatccactaatgatagaggtaatcattacaaagaagactgtcggtgtcagcatcggtatcgtaattttgaaaaattgcgtaaccgcacctgctccatcaattgctgccgcctcgtaataagatttactgattccctgcatacctgcaagcaaaataatcatgttatatcccactgtcatccagagtccgacaaccataattccaaacaatgcggtatgcgggtctgtcatccagttatgaccttttccgcctactgctttaagcgcactgtttaagatacccatctgttcattatacatccatttccataccatagctaccgcagctgacattgttacagaaggcaggaaatataaggtacgataaattgattttcctttgatttttgcattcagcagagctgctaataagattgataaaaacaatcctaacggtacagttataacaacatattttaaggtattaccaaatgttctccatacttctttgtcacccagcatctctttataatttgccagtcctacaaatgtagacatgttaaacttgtttacatcattaaaactaaaccagaagttctggataaacggccagatatagaacaccagcaaaccaattgtgaccggtgcgatcaagacatatcctgcaaaccagtcttttttctgtcttttcgacgctttttttcttggtacttttgctttcacttcagccattctttcacctactttattactttgctaaaagtgcatctgcttcttttttcagtccgctacaagcatctgcaagtgacatttctccattgtaagcttttgtcagccatgtagattctttgtcatacagttctgctgcctgtgcacaaaccggaagtggataagcttcatctgcatggtttgtataagctgctaagttgtactggctgtttgcttctgcgaagtatttctgagcatctgttctggcggagataactacacctgtctcaccctgaatctgctgtgcctcagcacttccaagccagatagcaaatttttcagcctcttctttgtttttagaaccttcatatactgcatatccaagaccgttgatacagttatcttctacaccattgaatgtaggaatttcaacacagttaattttatctttgattgtatcattagatgcatattccggaaccatgtaagaacctgcaaagttcattgcaagctgtccgccttcaaacattgcatctgcagatgtttctgcaagtgtagctgcacttggtgaaagtcctgcatcaatcatatcaatccagcactggataccttcctgagttttttcatcttcgtatcctgtttctgttgcatcatcatttaaaatccagccgccgtttgcgtatactgtctgataataccatgtctggaagtcaaccgggcacgcaaatgcataagtaccttccggaagtttgtcttttaattctgttgccagagccactaaatcatcataagtcatatcatctgtcggatattcaactccagcctggtcaaacagttccttgttataccataatgcgtttgtatcgaagtctttcggtactgcatagtttttgccctcacgaacatagttgtttaccagtgtttctgaaaaattgtcgttgatgtcagaatcagcgattgccgaagaaaggtcatctaagattccaccttcctgataagcatccagatgcagtacgtttaaccagaatacgtcaggagctgttccgccgcctgctgctgcttctaattttgtccagtattctccacctttgtatggtgttaactgaattttaactgtcacgttctcattttctttttcgtaagcttcaatcagtttttccattgcaggtctctgattttcatcccagataccgaatgttaattctgttttaccttttgatgaaccgcttttttcatcagaagaaccgtcactgcttgaaccgcatcctgcaagcatgcttgcaccaaggattgcagtcattccgaatgctaccatttttttcatgtttttcataatacttctctccttttcttattatgattgttctgtttttacagctatctatgaaaacggttttccgttttacatacttcctttttgccggatatcatccagctcaattacggctccgccgtgtaatcttgattcctccgctgcaagagcacagtaatgactctctacagatttttccagtgaagtaatagaaggactctcttctctgtttccaagtaagatatctacaaattcttctaccattacaatatctccaccgccatgtcctgaaaaatcatcggataattcagaagccggaatcaattctgtttttaattttgccccaaaaagtgtagtttcaatgaaatcatcttccacatcccaggaacccattgttacattcatttcacctttcgttccacaaaactgtgcatgtcttgcaaaatcagcagtgtgaccattcatggaaaaactcattgttgaaccgtctgtcatatttaaatttacaacctgatggtctactacatcgttatcacaatgataaacgcatcttccataaggtccggttttcaatgcttcttctacagattccggtgtcggaatttctgtaacaacatctaacggccagcgggtatttccatttcttgctccaattctctcactgtccagataaatgctttctgcatcataaggacaggtagcttttactttgcaaccatcaagacacctcttcgtacatccctccggtgcattttcttctttaaataaatacgtgcttccaaaagaagataaggatttacattttttatctgccagccacagatataaatccatatcatgacagcatttctgcaaaatcattggacttgacagttctttatttctccagttacctcttacaaaactgtgtgccatatgaaaccatcctacattttcggatgcattgatagaaacaatatctccaatcacaccagaatccaggatttcttttactttacggaaaaccggtgtataacgtaagacatgacagacaacaactttgcggtcacattcttttgctacttctacaatttcacggcactcatcaagatccggcgaaatcggtttttccagtaacagatggtatccctttcttaatgccgggattgcctgcgctacatgctgtctgtcctgtgtcgtaataaacatcacatctgcaagcttctcttcttttaacatttcttctgcacttgtataacatctttcttttggaacgtgatattcctccgctaccatttccacttttttcggattgacatctgcaatcgcaacaatctcaatcttatccggatggatttttgcagctttggcataagtatcttttccccggcttccaagtccggcaagtgcgactgtaattttatttgccatttcttcctcctcttttcttctgatgtagccttaaaatctttctgtattcatatcaagctgtttcaacccacaattgaatgaaattgcttgtgaatcaaagaaaagcgggtagaaacagctatccacaataataactgtttcttatgcccgctttggctccgctcatttttttgatttatctgctttcggaaacaatttcataactctgttttctgaaatcaactcttacttttgtaccatcagaaaaacttgtttcctgtaccatgtaatccccattcaccatctcatgacgcagcatttcacattttgcaactttttcatgtaaatcagatacgattttactgcgctcgatattttctttcagactgagttttactttatcatcaaatgcaccatcaaaattcggatatgcagcatcacgaatcagatacggtgctccgccgtttaacagggcataaagcatataatcatcttcatcgctgaccttatccatcatccatggttcaatcacacaatcatgataaaccagattgtataacggaaccggaacgccctcttttggagttccgggctgtctcatcataaagtcataaggtgcataatggcagaaaaccaaactcggaaccgcccagtcactcacttcttcagaacttggcaggattccacaagaaagcagatactcaaagcattttcctctgaattcatagcagtctcttctggtcatgcgatgttccggattatcacattcatcaccttcattacaggtaaatacgtccagatacgccccatctaattctataccatttcgttttatttctccaaaatttcgttttacataatagcttgcctgtgtcgcacacagataagactgtggaccgcctgcccatctttgatgcttcggaattgttccatccggcagcctgcatgcataattttcatcaaaacttggcgccgccaaataataatcacggtactgatcatggattccaaacatatagccacactcatgcatggtatctgcaagctttttcatgccgtcccaaccaccggcttctttacatgccggaaggtaatccggatgtttattatcatatcccggttcagcccagccgtctaagtgaagataaagttttttcactccggcctcatgaatttcttttatctcctgcacacgtgtctcaaacgttgtcaggtgattatttttatccggattttccggatcaaagaaatcagaattttcctgtacctgagttttgattcctttatgtacaaatgcacatccgattaaatcattaatggatggatttctcattgctttttcagacaaagtacgaagccttccctgctcatttacataccctctgtaaattttacaaagagtattataatcgcagtccgatgcaaatgtataacgcataattctgcgataatccattttgccaagacttggttcaaaataaacccctacgtgtgtatatggtccattcgccggatgattggcataataacctccgttccatggtgtctcacaaattgcaatataaccttcccgctcttttacctgaccaaaccacggcatataaccgcccgcagtttcaaaaaatccattaaacggaattgctcccagctccgtttcccagtcatttggaatgagcacaccctgttcatgtgtcagcagtgtataccattctttgcttggatttgtaaattccattgctccaggccagaacagctttttaatatgaagtccttcttcttttaaaggaatccattcaaaatacacatgtccggttgcatcttcaatccagattaatgtttcaaagctgtatggatatttttttccttctttttcaaaatcagaaaatatacttctgattccgactccgattcccgtctgatacgtttcatgagaaattgaagctgcctcgtcaaagaaaagctctccttcctcacattccatatatggacggaatccttctttccaagaccactttgtcttttcttgttccagtgtcaccatcagacttttttcgtccagactgacagctactgtcccctgttcaatttttctcatagcgtaatcctcaatttctacttttttctactcttttcatcacctttaaatataattaacagtatatacagtttttcggtcaatatgttgccttattaaatacttttcttgtcttattgcatactttttgttaaaatatccgcaggaggaatacagatgacctacattaaaaccacattgaagcgggaaatcgcaatcgattcgattatcacaatccactattttgaatacatgaaagactttgtctttcacggggaatctcatgatttttgggagtttctttacgttgatcagggaagcgtcattgtacaggccggagaaaatcatttccggatggaagccggcgatattatttttcatgaaccaaatgaatttcatgccatacgttccgtcggaaattcttcgcccaaccttgttgttatgtcctttataacaaactctcctgccatgaatttctttcggaagaaaaatttcaccctgaataagtcggagcgcactcttgtctcctgcattttaaatgctgcacgtgaagcccttgccacacccctgcatctgccctcgattgagcaggtgaaactcaaacccaatgcaccatttggctcacagcagatgattctgctctatctcgaactatttttaattacactcgaacaaaattatcttccgcttgatgcaaaaccaccagaacgaaaacgacattttccacttgccactccaatcgaattgtctgatacaaaagcgcagagaatcgaagaaatcattcaatatatgcaattttgtatctgtgaacagctcaatacgaaccagatttgccagcatttttccatgagccgttcctctttacaaaaactctttcaaaaagaaaaaggctgtggaccgatggaatattttaatcgcataaaaattcagcgggctaaggcaatgattcgagatggaagtaagaattttactgaaattgcaggatttctttcctacagctctccccaatatttttccagacaatttaaaaaatccaccggtatgtcaccgatggaatatgcttcttccgtaaaaggaatttctcaggcattaaaaggggatgattagaatctgctctaatcacccctgcttttattttccaaaacttttttgttttcttaatttcacttcttattttacacggaatgctacgacactacatgccggaattgtaaatttcagccctttttctgtgatttcataagcagtaaatgcttcttctgttacattttccggttcttcaaatgtattgtaagcatgcatttcctgatttacaatacttgcactgacgtcggatggattcaattctgtaaatgccacttctacttcttcactgtctgttgtagaaagattatttaaggtaattgtaacaataccatctttatcgattgataccgattcctgtaatttcggcacctgatattctttttcccctgcatctaaagtagagtttcctgtaatacagctttctacgaggtctgcatcctgatggtgacgatactgatggaatacgtgataggttggtgttaaaatcatcttttccccttctgttaaaataacagactgtaatacattgaccatctgtgcaatacaagccatttttacacggtcacagtgtttattgaagatgttcaggcttaaacctgctactaaggcatcacgcatcgtattctgctgatataagaatcccggatttgttcccggctctacagtaaaccagcatccccattcatctacaatcatgccaacctctttttccgggtcgtactgatccataattgcaccatggcggttaattaactcttccatgtacagagctttccataaagttttgtaccatactttttcatcaaaatcagttgcgcttcctttaatttcccatccttccggatgtacataataatgaagagaaagtccatccatgaatccatgagccattggcggctgtggtgctgcataacaagtttttaatacgccctctgtccagaaataatctgcaacatttgcacctccgcagactttcttaatcggtgcggaattgtcataatgacgaacataagtctggtatctgcggtataagtttgcatagtattccggagtcatatttccaccgcatccccagttttcatttccgacaccaaagtaatcgattttccacggtttctcatgtccgtttgcttttcttaaatctgccatcggagaaacaccgtcgaatgtaatgtattccacccattcgctcatctctcttactgttccgcttcctacatttccgtttacataagttttacaccccaactgttcacataattcaaaaaattcatgtgttccaaagctgttatcttctaccacaccaccccagtgtgtattaatcattttctttctgttttctttcggaccgattccatccatccagtgatattcatctgcaaaacatccacccggccagcgcaaaagaggaatccgcatctcttttaatgcctctactacatcggttctcattccgtttttgtttggaatcggagaatcttctcccacataaattccttcgtaaatacatcttccaagatgttctgcaaaatgtccataaatttccggattaatgtgtccctgtttattcttttcatttacatataattttgccataaaatcctcctgacttttactcctgtactctcggaattttcacctcagtcggtaagcttccgacttaagatagctcctccatgggatgcgcatctttcttctttccatcactatattggatgttgacttcgattgcaagtggtttctgaattttttgctgatttcgggcttttttgccccattttccatacaagtcgtccaacatcctataagttgtatgtgattttcgtcaaaaaagaagccctgatacaagttttttcactaacttgtacccgagcttcttttcttagtttttactcattctaaatcactgtcaagcggatattcgcaatccgctttcgctatttggttaaaaaatcctaatcttaagcatttaatggatatttatctgtcagctgttttacaatcgcttttgcttttccaatattttccttatcttttaccataagtgcaattgcctctgcaatctggtccatatcttcttcattcattccacgtgaagttactgctgctgttccaagtctgacaccacttgtcacaaatggagattcagggtcgtttggaattgcatttttattacaggtaatatttgcttcatcaagcagattctccattacttttccggtaattcctgttcctcttaaatcaaccagcatcaggtgattctctgttgttccggaaacaatgttaatgcctctctttaagagtccgtcgcacaatgcttttgcatttttcacgatgttctgctgataaactttgtattccggtgaaagtgcttctttaaagcagaccgcttttgctgcaattacgtgcatcaaaggaccaccctgaatacctggaaatactgctttattaaaattaaactgttttgcaatctcagcactgctcataatcataccgcctcttggacctcttaatgtcttatgagtggttgtagttgttacatgcgcataaggaattggacttggatgtacacctgctgccacaagacctgcaatatgagcaatatcgaccattaaatatgcgccaacttcatctgcaatctcacgaaatttcttaaaatcaatcacacggcagtatgcacttgcaccggctacaatcattttcggttttgcttcaagtgcaatctttctgacttcttcataatcaatcacaccttcatcattgactccataaggaacaattttaaaatatgctcctgagaagtttgccggacttccgtgtgaaagatgtccgccatgtgcaaggttcattcccattacggtatctcccggcttcagcatcgcaaagaacactgccatgtttgcctgtgcaccggaatgaggctgtacattcacatattcgcacccgaagagttctttcgctctctcaattgcaagacgttccacttcatctacacactcgcacccaccatagtaccgttttcccggataaccctctgcatacttattggttaaaggactgcccatagctgccataactgccttacttacccagttctctgaagcgattaattcaatatgggaattctgacgttccacttcatctgtaatacacttcgcaatttccgggtctactgcctgaatctcttcaaatgaatacatgttttctaacctcacctttcttatcatttcattctttacttttttaccagattcttcgtattgtggatatttgtttctctcacaaagacattctctgtgtaaaaaaatgcccagagccggaatcgaaccagcgacacgaggattttcagtcctctgctctaccaactgagctatctgggcttgtgcgaaattttcttgaatttcgacaacacagccatcttaccatactctatttaaaatttcaagccccttttttaatttattacgttaaagtcaagcggacattcgcaatccgcttcgctacttgctcatgaacgcagtcgcttagtgctctgcgcacttgaagcgggggaatgcttatctgcgttcaaaaactttttatttcccccaaaaaccctcctacttttccacctcctgtgaaatgttgtaattatgcataaaatgtggtatcctaaccacgataacacaaaaatttttaacgatacaagggttaatgaaattatgatgaatatacgaagattaatagccatctggagcggtcgtctgattaaaaccgcctgccagattaccggaaaacagggtgttacgctcgccggaaaagtcgcactctccatctatccgccaatcttaaaagaactggctgccgaagtgcgaaaagacacttttattgtatgtggtacaaacggaaaaacaactaccaacaacctgctttccgattttctcgtctcaaacggaaataaagtggtctgtaatcacaccggttctaatatgttaaacggtgtagtatctgctttcgttttaagcgccagattaaatggacacttagatgcagattatgcctgtatcgaaattgatgaagcttctactgtccgtgtgcttcctcatttcaaaccggactacatggttttaactaatctatttcgtgaccagcttgaccgctatggagaaattgatatcactatgaatctactctcccgcgccatgaaaatggcaccaaatatgaagcttttagtcaatgccgacgattccctttctacttatctggcaatggataataaaaatccatataccacttacggaatcagcgaacaggtattcaaagaccagaattccaaagaaatccgtgaaggtcgtttctgtaaacgctgtggtcacaaaatggaatacaaattttatcattacagccagctcggggattattactgtccgaaatgcggattcaaacgtccaaaaccggaatttgatgcttctcacattgatatgtccgacgggcttgcttttgatgtaaaagcttcccatatcaaagccaactatcgtggattttataatatttacaacattcttgccgtatttggcgcagcttccatggcaggaatcccaacaaaaaactttaataaagtgcttggagattacactccgcagtttggacgaaacgaacagttttttatcaatggcacgaaagttatgttaaaccttgccaaaaatccggccggatttaaccagaacatcggtgcagttatgactgataccagtccaaaagacattattattctgatcaatgataacagtcaggatggaacggatgtctcctggctctgggatgttgactttgaccgtttaaaagatgccaatgcaagctctatcaccgtaacaggaattcgaggagcggatatgcgtctgcgtctgaaatatgttgacattgcttctgatttggaaaacgatattgaaaaagccattgaatccaaaattaaaaatggcacaaagaatctttatgtactggttaattacaccggactttactctacacacaatattttaaagaaaatggagggaaaaaagtaatatgaagcttacgattggacatttatatcctgaccttttgaacctctatggagacaggggcaacatccagtgcatgatgaagcgctgtcaatggagaggcattgactcagaaacaattgagttcaccttagaagataaaattgattttaccaaacttgatattgtactgcttggcggtggttctgaccgtgaacagatgcttgtatgcgaccgcttaagaacgattcagaaaaattttcatgattatgttgaagacggcggaagcgtcattgcagtctgcggtggttaccagctcttgggacattattatgataccgatgagggacgaatcgaaggtctttcccttgttgacctctataccgaacagggaaatccacgtctgattgacaatatcgtacttcaaaatgatgcctttgagcatccgattgtcggatttgaaaaccatggtggacgaacttacattggagaaaaccgccccttcggaagagtactttatggtcatggaaataatggagaagatggcacagaaggtgtgctttacaaaaacgtggtcggcacttatctgcacggaccattgcttccaaaaaatccacatatcagtgactatctgattaaaaatgctctaaaacgaaaatatggcacggatgaacttacaccacttgatgatacacaggagttagaagcaaatgcttcgatttatcagcggtttgtaaaataaaaaaagatgtgggaaacctttgaacgaaactttaaaggtttcccgcatcttttatttattctgtttctatttactttattttttctcaattttccgaagtaacggaagtgtaaatttcgcatcaaagaacgaaataaacggacctaagcaaaatgcacttaacagtgtaccaatcccaacgattcctcctgccagaaaacagataagcgcacacaaggcatctgtcgaaattctgtgccagaaatatgaaatcgatggtttgcgcattgccataatcagcgacatactgtcataaggcgcagcgccaacatccggtgtctgatacatggatacaccaaaactgcacacaactactccaatacagacaacgattaacctctgccacatcacttccggaattccaattccgttactgagcagattataaaaaaatgtcactatgtatcccaaaaacaatgcgttgactaccgttccggctccgatgaattttcgaccgaaaataatttcaatcacaaaaaccgccagattaatcaataccagaaaattcgcataagccattcccacgctgtctgaaagtgccattaccatcccgctgtacgggtcatttccaagaccggaaagtttaaaaaccgcaatcccaagtcccaaaaagatatttcccactaccataaccagaagccgtccccatccggctttttcaaaataccttcttatcatttttctttttactcttctttcatttttttgactctgttaaactcttctaagatttctttttccggagcttttgtacacaaactgaaaatcacaatgcacaaaatgctgattacaaaaccagttgcaagagagtataaaccagttgcaatacccagagtctgtccattaatgaacggaatataatcccagataataacggttaatcctcctgacacgattccggcaactgcgcctgcaaaatttgttcttctccaaaacaatgacatcagtacaatcggaccaaatgcagaaccaagaccagcccatgcatttgataccagtcccataatactgttgtccggattccatgcaattgcaaatgccagcactgcaaccacgataacggtgacacggcttacttttaatactgttttttcatccgcctgaggttttaaaatatctttataaatatcttttgaaacggaagacgcagtgactaggagctgagaatccgcagttgacataattgctgccaaaattccacataagaataccccaccaataaacggcagacgtaaatcctgtgtaaatatctttgtaatcatctcaataaatacactttctgttgaagcctgaccttccgttcctaaaataaccggatacagataagctcgtccaagcacaccgattgccactgctgcaaagagagacagtgctacccatataatagcaataactcttgattttttcaattctttttgattctttacagccataaaccgggtcaaaatatgcggcattccacaatagcccagtccccatgcaagctgagagaaaatttcgataaaagaataagaactttctccatttcttgtcatgcttaaatatgcctgatgtccgccaatgacctggctttcatctaacatggcatttaaatttccacttccaataaaacaatacgcaagcacaggtacggcaagcagcccaaccagcatcagacttccctgaataaaatcggtcacacaaactgccataaaaccacccataaacgtgtaagcaagaataacaactgctccaattgcaagtgcaatgtgataatcaattccaaatacggaatgaaataattttcctccggctgataaagcagatgccgtataaaccagaaagaatattacaattacaatcgaagatactaaaagtaatacacgttttttatcgcgaaaccggttttcaaaataagccggaagtgtcaatgaattatttgcaacaattgtataccgtctcagacgagaagagatacagacccagttaaacaccgttcctaaaaacaaaccgacagcaatccatgcctgaccggttccaagtgcataaacggttcccggcaatcccatcaagagccagccactcatatcagacgcctgtgcagacaaagcagccacccatccgctcagtccacgtccaccaaggaaataatcttccgagttttttgttttcttcatataaaccgcaccgataactaccattaatatcaggtaagctgcaaatgccgctaatacgacaacaatatcattctgtttcatcttttttctccttattctgcttctgtcttctgcacgcctcaacctttgacggcatgcatcaaagattggtttacttctgtttctgtgcttttcgacgtccggaaagttctgcaactgcagtataaagaacgtctgtagaagaatttaaggctgtttcacaggaatcctgaatgactccgacaataaatccgacaccaactacctgcattgccaaatcattggaaattccaaataaactgcaggcaagcggaaccaaaagtaaagaacctcctgctacaccagatgcaccacaggcactgactgcggataatacacaaagaataattgctgttggaaaatctacagaaattccaagcgtatgagttgctgcaagcgccagaatagaaatcgtaacggcagcgcctcccatattaattgttgctccaagaggaatggaaacagaataagtatctttatccaaaccaagttccttgcataaattcatgttgaccggaatatttgcagcagaacttcttgtgaagaatgctgtgattccactgtcttttaaacatttaaatacaagcggatatggatttttacggattccgatataagtaatcagcggatttactaccagtgctacaaataacatacttcctactaaaaccagaatcaaatgtccataactgagcagagcatcaattccctgctctgaaattgttgtaaataccagccccataacaccaaacggtgcacaactgataatccatcttacacactgagaaatcgcatcggaaatatcagtaattgcctttttcgttccatcccctgcttttctaagtgcaattccaagaagaaccgcccaggaaaggattccgatataatttgcatttgcgatagcatcgatcggattggatacaatattcataaacagtgtctttaaaacctctccaaccccacttggagcactgacatcctccacacctgctgtcagggtcagttccaccggaaacagaaaacttgctatcactgcaaccgtacctgccaaaaaagtaccaagcagatataatacaacaacggttttcatatttgtcttttttccctctttatgctgacacaacgcaccagacacaagaaagaataccagaatcggagcaaccgcctttaatgcaccaacaaaaagctgtcctaaaagcccgattacggaaaactgcggaacaaccataccaagaataataccgataatcaaaccggcaataatcctttttaccagactgatgctgttccactttgtcacgagttccttcattttgtcttttctccttttttcctctgtaccctcgctctcctcatatcacaaaagtacatcgctttatcaatattcgctcatcattttatcacaatcggctcaagaagcaaagcattttgtctttctccgcaaaatttttgtccttgtaacgaaaacacgcaagattctctgtgtattttcgctgttttttcgtgtttcttttagagcgcgagacgttgcagaacgtccggtggacgttcgctttgcaacgaccggagcggagcggagacctcgaaccttcgagccccggcggggctcgaaaacacaaaaaagatggtatccaaccggataccatctttttgtgtttcttttagagcgcgagacgggactcgaacccgcggcctcgaccttggcaaggtcgcgctccaccaactgagccactcgcgcaaagagcgggtgatgggaatcgaacccacatatccagcttggaaggctggtgttctaccactgaactacacccgcaggttatttaattgttgctgtctcgttaagacttgtttataatacctcaaattgtttctattgtcaacactttttgaaaaatttttttaatttttttttaaagggactgctgccttatttccaagactgcaatccctctctttattatttatgccagaccatgtacttcaagccaatggtctaatgtttctttattgctcttaattcttcttgcacgaatctggaatacaatcaatgtaagcaaattaaatactacaaaccagataagcagataaatcactgcgttcataatactttcgccacctgcgattgtgcttctgaatgcctctactgtataagtaaacggtacccagtcatgcaggtattttacaaagtcaccggaaacttcaagcgggtaagtaccaactgaacctgccagctgaattaccataaataccaacattaagaaacttccgacttttccaagtgagtttgtgaagaagtacataattgacataaatgtcacacttgccacacaaacaaacgctaatgtcttgccaatttcaagtggtgtaaatccatcaaatacatgcagtaatgcaatcattacaagaccctgtaataaagcaattgtataaagtacagaggctttgctaatccaccaggagaatcctgattttaatttgcctttgtaacttgtcagaggatacattaaactaaatgcgatacatccaacccaaagaccaaccgacatcatatatggtgccattgcgtgtccgttgttttctacggttgtaatctttgtttcacttgcctctaccgggcttgagaacatgtcataagtattgtcgtctgccttggtctctttgacttcttttgctccatccgcaaggcttgttgccaatgtgtcacttccatcataaacttgatcaagaccatcgcctaattcttcacttccgtcacgaagctgtccggctccgtcactaatttgtgctgctccatcactcaactggctgacaccgctaagcagtgtactattatttgctaccagctgttttgttccggatactaaggttgttgttccatcttttaactgacttgcgccatcataaagctgtccgcttccggaagataactgttttgctccatcatctacctgtttgattccgcttgagagtgttcccattccgtcatctaaacttccggctccatcgtctaactgtttgactccgtctaccagtgtcggtacagcggatttcaaagttccagttccttcacttaaactgcctgctccatcgtctacctggctgattcctgctgcaagggttcccattccggtatctgctgcttctgcacctgcgcttaatgcttttgcgccggtgtttgcactctggatacctgctaaaagttgagatgcaccgctctggattccgcctaaggcttctgacttaaactgagttccgcctgctgctacctgctggattcctgctgtcagtgccggactctgttctgcaagctgttttgttccggctgccagtgtctggcttcccggaagaatctgagtacttaatgcactgttaattgttgaaattccagttgtaagtgccggtgcctgtgctgtaatctgctgaacaccacctgtataactatttacaccagtttttaaactgtcacttgctgatttcaatttatcaaccgtaacaattaactgttgtaactgttctgcgcttacttctgcctgtgcagaagttgaagtgtttgttgttgttgtttcaacgcctgccactttgtcaagctgtgcacttgcattatcggctgctgatgaaacgttctggcttgcacctctaagtgtttctgctgcacttgcactctgggatgctacatttgcaagctggctgtttgcgtcatttacagatgctgcatttgcattcgctgctgcaatcgcctgatttgcaatgtctgctacctgattgatatcaccatttgcaacggctgttgccagtgcttctgataatccatcaactgaagtaaccgcttcctgattggtgctgatgcttcctacgctgtctgctgctgatgaaagtgcatctgcctgactctttaatccattcactgcatcttttgcaccagatacatctacgctaacttcttttgttgtgctctgtgaagtctcgtttgctgaagcagttgttcctgccatctgatgaagcattgcggaaagctggctaagaccatcattaattcctgttgctcctgctacaagctgtttggagtttgctccatctgttccatttactttttcaagtcctgcctgtaatgcttttgcaccactttctgcacttgatgctcctgcagttacctgctcgagtcctgccgaaagctgagatgctccattatttaaagctgtggaagattccggaagacttgctgtgctttcctgtaactgattaagtcccgcacaaagttttgccattgcctggtctgctgtactgattcccattgtcagagaagttccaccggcttcaagctgttctgttccggctgcaagctgacttgctccagtttttaaactagctgttccagtttttaattttccagaaccatcaactaactgagaagttccaccctttaactgaactgcgccatctgcaagtgcatacacaccatcctgtaaggttggcacctgtccatttaactggtcaagtccggtctttaatgcactggaaccatcttttaactggccggaaccagatactaactgagaggttccagatgcaagctgtgcggttccggttttcgcagttgcaataccgtcttttaactgacctgctccactgtcgagctgtgttgctccactgccaaccgtactgacaccatctacatactgctttaatccaacttcaagtgtatcactaccatctttaaaagtaagtgaactgtctgctaaaacattcagattttcggaaatggtattatttccatcgactaactgtgtaactccgtcttttaactcttcagagccatctgccgcttcctgcattccatctccaacagttacaatctgatcaaatacagtttctacataagtctttgttacctcttcggccacactgtttttaatcttttccattgcagtttcactcattttagaagcaatgtagtttgttcccggattggtatcataatcgagttccattttctgaggttcttcatccataactgtggatgcattttctgagaagttttccggaatcgtaattaccatgtaataagttccgttttttaaacctctggctgctgtctcctggtctacaaagttaaaacaaagagaatcctcatctttcagcttatcgactaatttctctccgactttaagttccttgtcattgtaggtcaccggtttatctttattgactaccgctaccggaagtttatcaagatttccataaggatcccacattgaccccagaaaaagtgtggtgtaaatcgtcggtattgcaataacagcaattacaaccactaaaagcaacttattcttgaacaagcttttccactctttccctagcatatacattcccctttccttattcagttttctctttcggatatttgttatctttgaaatgcttatcatttctaaaagataattgataactctgtttctttctacgtcaaatcgcttatccgatttcgatttgtttaacgtactttgaatagtttaatagatattgtgttgattttttcttcatgatgaattatactaaaggtgcaacagtgatacaaccatcaataactagtttttatgtacattaatagacattttttatcatttatgttgctttttcttcaaaaacctgagaggagtcttatatatggaaaagaaaactgaccgaagagtccgaaaaaccaaagctcaacttcgtgccggacttgcgaaattgatgcagacgaaaagtatcaaagaaattacggtaaaagaattagttgatgaagttgatattaaccgttctactttttatcttcactacacagatatttaccagatgttagaatcaatcgaggatgagcttgagggggaaatcaatcagattgtaaataatcatcctgtggattcttattacaaagaaagtttccctatgattaaggaaattttagaagtattatgggataaccgcgatatctgcaatgccctgcttggttcaaacggagacatggcatttgtgcttcgtatggaatctattatttcacaacacagcctgcatgttctgactacaacatttgctacagacgtaaccaatattaaatatgcttatgccttttgtctgaccggttgtgtgggtatggtcaaatcctggctggaatctggagatactacagataccccgcttcaaatggcagaattgacttatcatctgattatgaatgcactcaaagatatcaaacgactgccaagtacaactttatagcttaaatcaaacatatacgcaaaaaggttcagaagaaattcaacttcttccgaaccttttcttgtttctttttcattttttaaaaatcaaatgtcgccgttttcgtatttcccatattccatttattacgaagagtcacatacaattctgcatttgttgcttccacataaggttttacatagaatactactcccagaccacaggtcactgcaccaagcagtccccaaagaataaacgataaatccagcacaaatgtattcatcttttctccatccatcatctcacggctgatgcggattgcatcccgataattaatatccggctgttctgccagaatatatggaaccatgcggtaagaataggattttacaattcctggaattacaaacaaaagtgtccataagaaaatatataaattctgcatgaacattaccattgccacatttgcaaaatttccattctgaaatccaaatcctatctttgaaacaggtgcattatagtctcgattttcaataaaaaagcgaactgctccaaccatcaatacatttaacacaaaaatctttaaaatcagaacaaataatgtaactccacccacaatcggcagtgaaatatctgcggaatagctactgtcatttacgacaccattcactgtgcctctgacatcataactgccacctatcgaagctgttgcaattgtaatcatcaaacctgctaagacagatgctgcgtagtttctatggaagcaaagttttcctctttcttttaagtctgctctcgtccacataatcattctccctttttatctcaatattcgacttgaactttattttatctccgctgttgcttctttgagccattctttttcttctttgttttccaacaatggctctactacttcatacacatgtttatgatattcatttaaccattttaattccgtttctcccaaaagttccggaatgattgcttctcgttcaaatggcacaagcgttacgacttcaaagttcataaactgtgcatagtcatttttttctgcttttttgcacatcagcaggttttcacagcggattccgtattttccttccagatacagtcctggttcatcggaaatcaatacgccttcttcaagcggaatcattccacccggacggattccactgttccagttgatgttctgtggtccttcatgtacatttaagagatatccgactccatgaccggttccgtgattgaaatccagtcccgcatcccacagtgcacctcttgccagtatatccagatgtgcaccgcctacgccatacgggaattttgccattgccagacgaatatttccttttaatacaagcgtaaaatgttttttctcttcttcgcttaacggtcctaccgcaatcgttcttgtgatatccgttgttccctgccagtactgtccgccggaatcaatcaggaaaaatccttttgattccacttttgcacagtcctcttttgacggtgcataatgacacattgcagcgtttgatccataagcacagattgtttcaaaacttaaatccagacagtctttatcttcttcacgaaactctctgcttttttctgcagcattgtattcatccactgttccctctggcaccgttttctttaaccagtaaataaatctgcacattgctcttgcatctttgatgtgcgcaatgcgttcattttccatctcaaccgcatttttcattgcttttgccggtttggtcggattcatcgcattgactgtggtaacttcttctggcagattttcaaataatgtatagtttactacaccttcatctaataaaatcttactgtcttttgcaagtgtttttacttcttcataaatcgcaaagtatgggcggagtaccactccggctttttctaattcgttcttgatttcatcagaaaccacgccatcctgcacatagaaaatgacttcgtctgctttcacaatgacataagaaagcacaaccggattgtaaataatatcgtttccacggatgtttaacagccatgcgatatcgtccagactggataagatgtgcacgtcagcttcatattttttcattgctctgcgcaccatctcgattttttcttctctggatgttccaacatattttatatccacaagataagccggttctttggacagttccggacggtcattccagatgccgtctaataagtcttcctgacaatagaaccgtcctcctttgtcttccatcatttttttgtatgcttttccctgtgacacgctgatgactcttccgtcgcaggcaaggcaggaaccttttgccaggttcatttccagaaattcatcgactgtcggaacgcctggttcacgcatcttcattaaagtaactccggtatcttcaagttctttcgctgcctgaataaaatatcttccgtctgtccataaatatgcctggtcatcggttacaagcagtgtacctgctgaaccactgaaaccagaaagccattttctggctttaaaataatcccctacatattcagactgatgaaaatctgctgtaggaaccaaatacatatcaatgtttaattcctgcattttttcctgtaattccaggattctttctctgttctcactcatgttaaaaacttcctctcttgcttctatctcttacttctatttactgaattcctttcatagtaagggaaattcgctttttcttttcatccacacttaacactttgacttccacgatgtctccaacgctgactgcttcaagtggatgtttaatatatcggtctgtcatctgtgaaatgtgtaccagtccgtcctgatgtactccgatatccacaaatgcaccaaagtcgatgacatttcgcactgtaccttttaaaatcatgccttcttttaagtccttcatatcaagcacgtcagtacgaagcaccggttttggcatttcttctcttgggtcacgtcctggttttccaagttcttttacgatatcacgaagggtcatttctcccgttccaagagactctgccatctttctataatcttttacataaaatgcaccatgacctttgaaaatatcttctgcagttgttcccatattttccagaaatttttctgctacttcataactttccggatgcacactggttgcatcaagcggattgcttccccctgtaatacgaaggaaacctgcacactgttcaaacgctttcggtcctaattttggtacttttaaaagttcttttcgactctcaaaacgtccattttcctcacggtatgctacgatattttttgcaatcactttgctgataccggaaatatattcaagcagggaaaccgaagcggtatttaaatcaattccgactttattcacgcagtcctctacaactccagacagggcttcccctaattttttctggttcatatcatgctgatactgtccgacacctatagatttcgggtcaatttttaccaactctgcaagcggatcctgaagtcgtcttgcaatggaagcggcacttctttgtcctacatcaaagtttggaaattcttcggtagccagtttacttgcagagtatacagaagctcctgcctcgtttgtaattacatactgaaccttctccggaatttcttttaaaagttccacaataatctgttcggattctcttgaagcggttccatttccaagagaaatcaggctgacattgtattttttaattaattttttcagagtttcttttgccgacgcaatcttagcgggagtggtcggtgcagtcggataaatcacaaccgtatccaagacttttccggtttcatctaccactgcaagtttacaaccggtacgaaacgccgggtcccatccaagcactacttttccaacaattggcggctgcatcaacaactgctgaagatttttcttaaagactttaatggattcatcttctgctttttccgtcatgctgtttcggatttctctctcaattgcaggtgcaatcagacgattataactatcctcgattgcttcttttaatacgtcctgtgtatttggattttttcttgtaataatctctctttgaagatatcctaaaatttcttctgtcggagcttcaatttttacgcctaaaaacttctctttctctccacgattaatagcaagcacccggtgtcccggcattttttccacacgttcttcatattcataatatttctcataaacagatgtctcttccggtttttttgcagttgaaacaagcatgcctttcctgaaagtacactcacgaatttcactacggtaatccgctttatcggaaatactttctgccacgatatcttttgcaccggaaatagccgcttccactgttgtcacttctttttcttcggatacaaatgccttcgcttcttcttcaagggatttgtctgtcatctgtaataaaataatgtttgcaagaggttccaaccctttttcttttgcaatcgttgctctggtacggcgtttcggacggtatggacgatataaatcctctaccacaaccagcgtctgcgcttctaaaatctgtttctttaattcttcagtcagctttccctgttcttcaatactggaaagcacctgagttttcttctcttccagatttctaagataagtcagtctgtcgtttaaattacgaagcacttcatcatttaaagcaccggttacttcttttcggtaacgggaaataaatggaatcgtatttccttcatctatcaattttacagcagcctctatctgccacttttccacatttagttctttggtcaaagctaaaataatgtccataattttctccttttaaatcaagcaattcttgccatttgctttctttctaaccttaccaacctatgacagttttgtcaagaaaacaaaaaacgcaatgaacttttttattaaaaatccactgcgttttactcctcttgattttgtttttgaatttgatttcgattgcagatttccagacctgcctttaaaaatacttccaattccttttgtaaatcagaatcaaattcctgccatactttatttaaactgctaatgttttgtacatcctcataaaaaacaacagatggcggataacccagattctgatacaacactgccagaagttctgcattaacacctaatctgcctttttcaatttcacgatacctttttgtcgtaatatctaaatgctgtgccatcttatcctgtgtaatatcacttgcttttctcatccaataccagattgttcttgaatccgtctctttttcaaaagcagaataacggagcagtctgatttctttggtataatccactccatttttctgttcttttcccgaaatattgataccctgctctattgtccagaccataagctgtaagaaatcgctttttatttctttcttacagacacccagatagtgatttaatatcgtttcttcacattcctctcctgtcagcagataatccatatcacagccatgactgtcaaaatttttgagttcttctgctgaaataatggtctttccctgttccaacttactatagtggctctgggtaacacccatcatctgactcatgctcttctgattcagttttctcttttgtctgtacatctgcagtctttgcaatactccttcgtatgcactgcccatagtgttacctcatttccaacggtcaaatttttcttatctttttattgtaatatttttcaaactgcccttttatcccctatttttgactattctgataatttttagtcaattttaagagattgacagctttcatcccaaacatttgcctgacacataaggtttctgcgcactttaagcggcggaatgcttatctgcgttcaaacgcttgccctaatcggtacaacgtgttaaaatgagcaataacaatttttttatttttgagaaatgaggtttttacaaaatggataatttttataattcaaatgataattttccgccacagacaccgccttattatgaacagcctcagcgttatcaaggcagttcgagctgtgcctccgcctctttgattcttggaattctttccctgttatcaatctgctgtatgccaccgcttgcccttgtttttgcaggacttgccttgattcttggtgcactttccaaaggcgaccgaatccgtccgcaaaatgcgcgtgtcggcatgattttatcaggtatcagtttaatagctgttttaattttgcttgctgtatttctggttcgattcacttcaaattcgaccaacaccgaatttttcaagcaatatctggacattatcgagcatccggacgattattccgaaaatgacatctacaattttctgtatgattatctttatccaaacgccggttcagattccgatcataactatgaaaattcacagccttatcactacgatcatacgccttatgatggagatgattccgatggctacgactattactatgaatatccgactccacatcaggaagattccgggcatcataatgtaatttaaccaaatcaagcaagtcccttctgataagcgcgtagcagctatttggttatgagcaagtagcgtagcggattgcgaatatccacttgactaaaacaaaaaaatcctgctttgaggaatcgaaaacctcaaaacaggatttttatttttctaatctgatttttccagtctaatttttttattttaaattttcatattcttttgtttccagttcaattaccggttcttcttttttgtcaaactcaccttttaaatccagataaaacgctgccatcgttgcttccatataaggcatcagccataacagaccaatatagcaggtcagcatacttgccagaagcagtggaataaaacttaaattaatatagaaataacgccacttatttcctttcataagggaacagctttttttcattgcatccactgctgataaattgatatcatccaataacagataatccgtaacagccaaaaacagatttaaaaccaaagctactattgtatccacacacattgcaagtacagaaagccagatataagaaatactgctactgtctgtccagagtggaatattaaacggcagaccaattacaaactgtacaatcagaataatcaggtgtacaataataaaacggtctggatgatgcgtaaatgcaaatgccaggtcttttccttcaaaagactctccacgacagatatttaccatcattttactatatccagccttcaacacgctgacaagaagtgaaataacatacactaaaatctgcgaagtaaccagtcccattgttgtaccggtacccatcgtagaagaaataaaaaaagagggaagaaaggaacaaagtccaagcagtaaaattcctgccatcggagttccataatttccactcagttgctgtctcgcaatcagcttaagagaagcagaagttcttttcataaaataaagtctccaatcttttgtaattaactgtttatttcaattgtccatttcaattagtgtaagattattttttcattttgtcaagaaaagaggatatattccattatgcataaacaggaagaaaaaaatctatatctcttagggtggattttactcggaatttttctaagttatttattgatagcaaagttttcccatttcagaaccttctttcatctcccctgtctcttccgtaccctgaccggatattactgtccgggatgcggcggaacacgggcatgtatcgcctttttacatggacattttttacgttccctgctctatcatccggttgttccttatacagcagtcgtatatttgattttcatgatcagtcacagtatcgaacttttatcaaaggggaacttcgccataggtttaagataccgggacaactatattaaatttgccggtatcattattttagtacaatggattttacggaattttttgaaatggaaatggggaattgatgtgcttggaaattaaaaaagaggctgtttttgacagaacagcctctttcattttttacgctttaaaacggattctggagatgatttccggaagttttgctgcttttgcttcgtactctgcttcgcttaacggtcctgtgataattgcaaattcgccttccacatccggaacggatacagtttttactgcaccaaatacagcttttactgcatctgccatttccgcttcctttccttttatacgaaccaggaatggatgaaccacttctttgatatccattaaatctaatttttcactgttccagcttgtcatcacattttcgtgaagatgttttgcacaatctacaacatctcctacaactgcgcttgctgtcggaagttttcctgctccacttccatagaacattgcatctccgagtacatttccatgtacgaagattgcattaaagacatcatttacactgtaaagcgggctgtctgttccaacaagtaccggacttaccatcgcatagaatttatcattttctttcttgcttgtcgcaagcagtttaatgctcatgccaagtgctgaagcatacttcatatcttctactgtgatttttgtaataccttctgtgtaaatctcttcataatttacatggtttccaaatgccagagaggacaagattgcaatctttctgcaggcatcatatccctctacgtctgcttccggatttctttctgcataccctttttcctgagcttcttttaatacttcttcaaaatctgcattctcagcctgcatttttgaaagaatatagtttgttgtaccatttaagataccggaaatctcatcgatctcatctgctgttaaagaagagtgaagtggacggataatcggaataccaccgccacagcttgcttcaaacatatagttaatatttttctcttctgcaattttaagcagttccaaaccatgtcttgcaactaattctttattggatgtgcagacactctttcctgcctgaagtgcacgtttggtaaaagtatacgccggttctacaccacccattacttccactacaatatctacttccgggtcattgataatggtttcataatcatgaaccaaaactttttctaccgggtctcccgggaagtcacgtaaatctaacacatatttaatgttgacttcctgtcctactcttttattaatgctctcatgattggtgttgattacttccacaactcccgagcctactgtaccatagcctaataccgcaatctgtatcatctttcctctactccctacctaagattttcagatagtgaacgccctcgatgtgttcaatctccgccaccattgcttctgcatcaccctgtgcaggcaaaatctgtacacttaatgtaagactggcaattccgttaatcggaatactctggtgtacggtaagaatattgccatgatagtaggcaatcgtttttaatacacctgagagcagtcctggttcatcatccatctgaagaataaatgtaatattctgtcctttggttttttcacgaaaaggaaagatatcatctttgtatttataaaaggaacttctgctgattcctactgcttctacggcttcctgtaccgttacagtccgttttgactccaaaagtttttttgcctctactacttttaacagtacttccgggactgccttttctgttactacaaaataccttttattatctgacattcgcttcccctttgtttgttccaaaaatacatttgtgtttctccaaaagatattaacacattcttgtatttttatcaactatttttcttatttccaagcgcaatccattttagataagcattgataaaacggtcaatatctccatccataactgcatctacatttccggattcctcattggttctgtggtcttttaccattgtgtatggctgcatgacataagaacgaatctgatttccccagccaatttcagttaattcaccctgaataccggaaagtttctgctcctgttcctgctgctttaacaagtacagttttgctttcaacatctgcatcgccttatctttattttggaactgggaacgctcgttctgacactgtaccacaattccggtcggaagatgcgtaatacgaatcgccgatgaagttttgttgatatgctgtccacctgctccactggaacggtaggtatcaattcgcaaatcatcatctttgatttccacatcaacatcttcttcaatatccggcatcacatcacaggatacaaaagaagtttgtctctttcctgctgcattaaacggagaaatacgcaccagacggtgtactcccttttcggatttcaaatatccatacgcattttccccattaatctgaatcgtaacagatttgattcctgcttcgtctccatccagataatccagtacctcagtggaatagccatgacggtccgcccatctttgatacattcgataaagcatgcccgcccagtcgcaggattctgttccgcccgccccggcatgtaaggtcaaaatcgcattgtccttgtcgtattcaccggaaagcagtgtttttacacggattttttcaaaatccgcctgaaattcatcgagcatatcctgaatttcaggaatgaccgaagcatcattctcttcgtatcccatctcaatcatcagctcaatttcttctttttgtgtctctaatttctgataaatctgaatatcctcttttaaggtactcagctctttcatcattttctgggaacgctccggattatcccaaaaatcaggagcttccatttctctttctaattcttcgacccttttttctttgttagcgaggtcaaagtgaatccctcacttccactaatggtccattatagccgtttaatgtatatttaaactgatctaattctaccaatagcttcacctactttcatgaatatttttcttatttttattcctcatcgatttccacagaaaccatataaatggaaatctgtggctcgacttttattaccgtaccgcttaatttcttaagtggacgttttaaattacttgacattgcaatggcatctttaattgtataataatacatctgtccggacatggtactcgcacagtcctcttttaattctactcggtcaccctcttttaccagtccttctctttccattgtaaattctacaatctgtcccatttgttcaccttccggttttttgtttttgcccgttctcttttatctgtatctgctttagattctttttctgccacagcactgtttatattttttaccgcttccacatgggcatgggtcatttggataaattttgttttcttctctttgaatcggctttttcggaccggattcatctttatttgtaccggttacctgtgcaacctgttctctttctaccttctgttcaattcttacatgatacagcagacgaaccgttgtctcctgaatgttgttaatcatgttatcaaacatttcataagcctgcattttgtattcgactctcgggtctctctgaccataagcctgaagtccgataccctgacgtaactgatccatatcatcgatgtgatccatccatttctggtcgattacttttaagaggataacacgctctaattcacgaagctgttctgcttccgggaattctgcttctttttcctcatagagtttgacagcagcttcttttaattcctgttctacctgttttttctttttgcctttgacatcttctttggtcagagcttttaatggaatcgtcggtaagagtacagaattaaattcttctaaatcccattctgcggtatctacatcatcagagaagcacatttctactgcatgttctacggtatctgtaatcatcttatagatagaatcacgcatgttttctccgtccagtacacggcgtctttctttgtaaataatttctctttgttcattatttacctggtcataatctaacaggttcttacgaacaccatagttatttccttcaatcttctgctgtgctttttcaattgcattggaaagcatcttatgttcaatctgttcattttctgcaacaccaagtgatttgaatactcccatcagtttttcagaaccgaacagacgcattaaatcatcctccagagaaatgtagaagcgagattcacccgggtctccctgacgaccggaacgtccacgcaactgattgtcaattcgtctggattcatgacgctctgtaccaataattttcaaaccaccggcttctcttgctacatcatccagcttgatatcggtaccacgacctgccatattcgtagcaatagtaaccattccggcttcccctgcatgtgcaacgatttcggcttctttctcatgatattttgcatttaatacctgatgagggattccttccctctttaacattttactgattaattcagaggtctcaatggtaatcgtaccaaccagtaccggctgattttttgcatgtgcttctttaatcgcctcaacaactgcatggaatttttctttcttggtcatgtaaacggcatcgtcatagtcaatacgcgcaaccggacggttggtcgggatctcgataacatccattccatagatttcacggaactctttttcttctgtcaaagctgtaccggtcataccggatttctttgcatatttattaaagaaattctggaaagtgattgttgcaagcgttttactctcacgtcttacttttacatgttcttttgcttcgattgcctgatgcagaccatctgaataacgacgtcccggcataatacgtccggtaaattcatcaacgattaaaacctcatcgtcttttaccacataatcctgatcgcggaacattaaattatgagcacgcagtgcaagaataatattatgctggatttccagattttccgggtctgccaggttttcaatattaaagaatttttctactttatgaacaccctgttctgtcaggtttacgattttatctttttcatttacgataaagtcaccggtctcgatgatttcctcacccatgatagctgtcattttggtcatttcaccactggcttctccgcgctctaactgtcttgcaagaatatcgcacacttcatagagttttgtggattttccactctgtccggaaatgataagaggcgttcttgcctcatcaattaataccgagtcaacctcatcgatgattgcatagtgtaaatccctttgcactaactgttctttatagattaccatattatcacgcaggtaatcgaatcctaattcattattggttacataagtgatatcgcaggcatactgtgcacgtctctcatcatttttcatggaattgagtacaacacctaccgtcagtcctaaaaattcatgaacttttcccatccactctgcatcacgatgtgccagataatcattgactgttacgatgtggacaccttttccctccagtgcatttaagtaagccggaagggtagataccaatgttttaccttcaccggttctcatctctgcgatacgcccctgatgaagaataattccaccgattaactgaacacggtagtgctccatatttaatactcgctttgctgcctcacgtacagttgcaaatgcttccggaagtaaatcatccagtgtttcgccttcttccagacgttttttatactcccttgttttcccacgaagttcttcatcggaaagcgcctgcatagatggacgaagggaatcaatcttatctacaatcggcatgatacgttttaattctcgctggctgtgagtaccaaacattttctcaattatattcatacttaattatactcctgattttattactagcttaaacataagtgtcatactataagcgtatctacactataccacagtactatttattgtatcactttccagtaacgaaaacaagggcaggaattatgaaattcccgccctcgtagctctgatttttaccagttaattactaactgctttgtcatctttcctgttaaagcttcacttctcttatccggaccgtttgttccgacaaagagaacactggaagaagaatcgaaaatcttttctccttcgtcatttacgactttataagcttcttttgaaactgtaatggtcagctctttttcttcccctgcttcaagagaaacttttgcaaatccgcacagagccggatttaccggtgcatacttagaatcctgattcttgatatacacttctactacatctcttgttgctacttcagaatgatttttcacggtaacgcgaatttcagcatcctgctctttttccggtgcttttgcaaattctgccttttccacctgcacatccccatagcttaaaccatatccaaatggatataatggttcttcggtcagataacgataagttctgcccttcatagaataatctgtgaaatctggcagttgatctaaggtacgatagaaggtaatcggcagttttccacttggagaaacttcgccaaataagatatttgccagtgcttttccaccctgtgaacccggataccatgcctgaatgactgcctctgctttttcttctgcctcagaaagattcatggcacttccggtaaagttgcatacaattacttttttaccggtttctaatactgcatgcatcagtctctgctgactctttggaaattcaagattctctttatctccggacgcataagcatttccggtatctccctcttctccctcaagtgattcgtccagaccaatacatagtacaaccacgtcactatgctctgctacgctgagtgcttctgcaattctgtcatcttcctgtgcaagcgcttcttctttatccagaaataaatgacttccttttgcatacatgactcttacatcatcgccgacatagtcctgaattccttcaagtactgtaatataacgggaagctgttccatgataatttccatccagagagcttctgttatctgcatttggtccgataacaccaataatcttaagttcttcttttttgagcggtaagattccattattcttaagaagaacaatgctttcttctgctgcttttctggaaagttccagatgttctttggattctactgctgtatacggaatcttatcaaattcggtctcgtcgaacattccaagcagaaatcttgtagtaaagagacggattgcagcctcttttactttttcttttgtggtcagtcttttatttaatgcttcttttaaacacagataagtacagccacaatttaagtcacagcctttatttaatgccagtgctgaagattctacaccgtttttggttaccatatggtgttcatggaaatcacggactgcccagcagtctgacacataatgaccttcaaacttccagtcttcacgaagaatgtgttccatcagttcttcacttgcacagcacggttctccgtttgtacggttgtaagctcccatcactgcttctacatccgcttcttttacgcaggcttcaaaagctggaagataggtttcatacatatctttcttgtttgcttttgcatcgaaagaatgacgaagtgcttccggtccggagtgaactgcaaaatgttttgcacatcctgctgtctttaaatattctccatcaccctgcagtccttcgataaatggaactgcaagtctggatgttaaagtcgggtcttccccataagtttcatgtcctcttccccatcttgggtcacggaagatatttacatttggagaccataaagtaagccctttgtaaatgtctctatctccatgctttatagactcattatattttgcacgtgcttcttctgaaataacagaagcctctgccttcattaaatctgtatcccacgctgccgccattgcgattgcctgtgggaatacggttgctgtaaccggctcttgctactccgtgaagtccttcattccaccagttatatgcaggaattccaagtctttcaattgccggagcatcaaattttaactgacttgccatctcatctactgtcatctgtgaaaccagtgcttctgcccgttctcttgctttttttctgtctctcatctttttcctcaattcctctctttatttaccagcagactattttattagcagactttaattacaccttttacgatatctgctttattctttacgcaggaatccagtgcattctgaatatcatctaactcaaagtagtctgttacgatatctttgatattgatttttccggaagcaactgcatcgattgccatcggataaatatttctgtaacggaatacagttttaaatgtcagttctttgtcaagtgccataccgattggcagtgtcatttcaccgcttgcactgtatccgacaaatacgatagttgcgcctttatttgcaccttttattaactgggaagctgtaatctgagaacctgcggtttcgattccgaggtcaaatcctcttccacctgtcagttccataatgcgggcaaccgtatcttcttcttttccgttgataactgctgttgctccaagttccaatgctttctgcagacgtttttccataatatcaactacaattacattagatacacccattgctttcaaagaaagcagagttacaaggccgatgcatcctgcacctgtcacaactgctgtctgtccaagatgagcgcctccctgatttgcggcatgcataccaactgctaatggttcaattaatgcaccttccattgtacttacgttttccggaagtttgaaacaaaggtcagcttcatgtgcaacatactcctggaatacaccatctaccggcggagttgcgaagaatacaacgtctttacacagattgtatttaccctgtttgcagaattcgcattttccacaggtttttcctggctctaaggcaactctgtcaccaacttttaagtgttttacattttcgccaacttccacaacagtaccacctgcttcatgtcccagtacgaaaggagtttctacgataaaatctccgattcttcctgattcatagtaatgtaagtcagaaccacagattcctacatattctacttttacaagtacttcatcactcttcggtgtcggaacttcacgttcctgaatttctactttctgtaaatctgtcattactgctgtcttcattttcattttaactgccattgtcttgttcctcactttctttttttatttttctattgataatgttactctgctacattctttttccccgagataagaagtgtctctttccatgtcttttggataaacaaccaatctctccaatacaagtcccgcttctcttgcggaaactgtaattttattcaaaccttttttcaaagcaatctctgtacttcctgcatgttcctgattcaaaactgcctgttcccatggaatgcagcccggttctccacctttatagccatcctctgtaaatgtaaccagcttatccacctcgccatttacagaaactcccatagaaagttttcctccataaatcagtggatttgcaggagaagtataaagttttaagatgcactctttttcttcttcactaaagagttcatacgttacagacggagcattttcttttgaatcaaacgccgccgttaccggaaatgccttaattccgctttgatatttcccaaagtcgtataactctttaaattctacagtttctttctcatatgttcctgcatttttatctgcataatgaattgcatcgattacaaacatgccatgttctgcaagaaatgcacctttcggaagtgcactggtatcttttttcagtgcttttaccagaaccggaacaaactcagtttccgtcttaatttcaaaactgcaggatacttcttctccaagcggaaggttttcttcttttaaagaaatttcaacttcgtcctgaagtgcagtctctccggacattttggaaaattccagccattcgcatgaagtttcatcctgagattcatgtgcaattccatccaatccgacttttcttgcgccttcctgtatcttccattttacgcttccctgaccaccgttagcaatttgaattttagcctttttgctagaagaaactacgaaatcatcaatcacaagtgtaatcgggaaatactggttcgtataatgctgggttttatctgctcttgtcacgaccagcctcggttttttcggaagacgaattacgtgacgcaccggatatctccagtcttcatcattccagtttgtaaatccaatatgagaagccaattccattcctgcccattttccatctttaaatgctgccatctgagcttttaaggcttcatctttttcaatacaagcttccactaacttgtcatactcatttgcaactgcctttccctgagaagcatataagtggttttttccagaataaagatgcattttcagtaaattaaaggatgcttctgctgagaaataaatcatgctgaagtaagcatctcccataccacgctcctctaaagttttccacagcctttcattcttttcttcgagttttccacaaaaagataactgtttttcacattctaagtaatgtgccggatggtaaaccgtatcatttaaagattccggttttcttaatgcattgatttttaaatagccttctaatacttcctgaatttcttctcgctcttcttttgaagtatagcttccgaacatggatgaaatccatgctttggtatactcttttgtgctgtttggagcagaagaaccccatttttcaaaatcatatgccaaatccataaagtaatttaacggaaattcctggaatttcacatctccgacattgacaatccagagttctcttactccgtattcataagcttctgtcatctgctcccaaatcttggaaagttcggtagaagaaacccattcataagaaacagggtctccatgataatccagatggaaatacattccaaatccacctttatgatttctctcaaatgcttccggaagtgctctcatatttccccagttgtcttcgcaaagcagtaaggttacgtcctcaagttcttcaaatccacgcagtccttcttcgcttccaccaccaaaatagtaatcttctacttctttataaactgcaaataactgcggaactttctttccgtctgtttccagatgttcatgaatcatctcacgctgttttgtaataatttcttttaacagacgtacattatcggaaatcagagaatcttcgcccagcatcttgctgtcgttttctcctctcattccgactgttggaaatacattgtgaccgatgcttcgtttcacaccgtcctcccagaatcttaagattccttctttgtttgtcacatagctccatgcatctccatacggacttttcggtcctctcaccttgctgtattctgcaccggaacgcatacaaggttcatgatgagacattccgatataaattccgtattcatcagccagtttcatagactccaaatccggaccgtctaacataaagttttccgcccacatcgccggccataaataatttcctttcatacggaggaggtattcaaaaatatggtcatacatttttgcattaaaacttccaaaatgagaagttgcccagtttccacaacatggccattcatcattgatgaaaaatcctctgtatttcacagacggctcttttgatacaaaagaatcctcttcttttaagataaaagagtcctgtttcacgtactggcagtctccccagtcaaccattgctgtcacacctaacaactctgacagatgaaacagtccataaatggttccaagtttatcacttccgtaaataacaagtgcgctttcaattccttctaccggattttctgccacaataaacgcataagattcccgttttccttctacctgtccaagttttgaaatcttactgcacagtgtttctgccagttttccgcttcctgcagtcactgcaatcactgcctgttttgccggtacagctgtttcacagatttcaggacaaaatgagagtgtcccctctacatcttttgccactttgcctgctacttttttcacaccgattccacattcttctggaattacaaaataaagtcccttattctttgaaatttctaatgtagccatacatcctccaggtttatttccatgttttttgttctaaaaagaacccgacagcttgcgctgccagattcttttctctggttactgcttattttaattatttaagaaggtcttttgtatcctgataaatttcgtttgcttcgtctacgtatttctggctgcctttgttttcacagtcttttacgtaagcatcccagtctttatccagatcacgtttaccagtgatgaattccagagctgctgtatttacatagtccataagaggagtcttaactaagttcatttcttctttctgcatttcatcagcaagaattggtggttttaattggatatcttctttgcttgcatttactctttcgttccattctttttctccatcagagaatttagaatactgaagttctttagaaccgccgtaagcaaatacaccattaccaaatccatagtctacgtttaactgtttttctgcacctgggttaataccattgtagtagatgtcagagtttaatacgatatttccatcatcatcttttgtataggtttcaccttcaacaccccacagacataaagtctgtccttcgtctgagtaccataaccagtcgatgaaacgaagcattttgataaatccttcttcaccaagttcatctaaagcattctgagtaatcataataccattttcaagacgaccagctgcgctggaaacttttaactgtcctgcggaacctgccggaggagtcaggaagtataattcagctccatcgacctgcattttaccattctggatatcagaataaatctgatagttcatatttaaaacataagaatcaccacggaagaattttgcctgcgcctgcgtggtatcctgtgtaaatgtttcagggtcaattaaaccatcttcgtacattttgtggaacattgtgaggtattctttgtattcgtctgttgtatcagcgaagtagaattctcctttatcaaagtcaaattttgtaccatcttttaagccccagtcaccaccgtcattggagtaaccacctgttacattataaactgttgcagcgatattcatggtacttccgaacccaaatccatcagaccatacataatctgcttttgtatattcttttactttctttaatgcttcataaaagtcatcccatgtccaggagctttcatttgaaaggtctacacctgctgcttcaaatacatctttacgaattgcaagagagtaaccaccggctgttgtctcccacatacccggcagacgatagtatttaccgttggatgccagaatctgctgtaagtcgtcttccatgccccagtcttttacgcatttttgatagttcggcatgtactgaacccagtcactgattggaacaatctgaccgctgtcttcgtaagcagtagaatcataagttttcggaataatgtaaggagcactaccactgtttacagaagcagaaactttatcattgtagtctgttcttgcaacgattgtcaggtcaaatgttacatttgttttttcttcgattgctttccaaagtaaccagtcctcattgtaaggatagttttcatggtcagagtacatcatggaatattttactgcttcgtctgaatggaaagtttcgtcttctccataagtgtaatcaaggtctttgtctgcatcttctgctgaaagagtcggtccgtctttgctgtctgatgatttgctgccgccacagcctgctaatgtagtgccagccatagctaacacaagtgtcattgctacgagtttctttttcataattacctccttaagttatgattttttaacgtacgtttaatcatacgcaattcacatagttaaattataaatttccttatatgcgggtacgccttggcgtaccctgttaaaacttgttaagtatcagccttttactgctccgattgtcataccctgtacaaagtatttctgtacgaatggataaacacagataatcgggatagatgttaataccatggttgcagattttacagttgcctgtacactacttgcatcggaagaaccgatttccgtattatttgccccctctactaactgtcttacatacagagcaaccggccatttgtcttttgaatctaagtacagcattggcgtgaaccattcattccacatggttaccatatagaacagacacatggttgcaatgattggtttggataacggaataatgatttttaagaaaatctgataagtattcattccgtcgattgctgctgcttcttcaagttcttccggaagtcctgcgaagaaagatttcataaccagtaagttgaatgtactgattgcatttggaagaatgattgaccacatactgtcctgaagacctaaccactgtgtgattacgatatagtttggaatcataccacctgcaaaatacatggtgaatacaactaacggtgtaattactttgtttaatcttaatcttggctttgacagcggatatgcaatcagcgctgtacatgctacagagataaaagttccgactactgtataaaaaatggtatttccatagtaacggaagaactgattatctcttaagatatatttgtaagtgtttacgttaaatccgattggataaaaagtaacttttccggcacttgcagcagcatcactgctgaatgactgtgctacaagatatacaaaaggatacagggtaataaagatgacaaaaatcataataatcgtattgattacctgaaaggcacgatatccttttgttggtttcatattgttcattttcttcctgtactcctttctaccataatgatgtttctgtaaatttcttagataagaagttcgcagatgtaacaagaatcagaccaattacaccttcaaacagaccaactgctgcggcgtaactgaagttaccacctgtaatacccattctgtataccaaagttccgatgatgtcggctctctgctgattcagtgggttgtataataacaagattttctgcatattacttgatgttacgataccaccgatatccatgattaacagggtcatgattgttggcatgattcccggaattgttacatgaataacctgctggaatcttcctgcaccatccatagatgctgcttcatataattcagtgttaatacctgtcattgctgccagataaaggattgtaccccatcctaatgcctgccatacaccagatgcgatgtatacaaaatcgaaccaacctggttcagacataaatgcgattttatcagctccaaacatctcaatcaatttgttgattggtccttgtgctgctaacaattcttttaccataccacagacaactaccagtgagataaagtgtggcagataagaaattgtctgcacggatttcttccacattttctttctgatttcattcagaagaagtgcaaagattaaagtaaccgggaaacgcactaataaatatccgatacttaatctcagtgtgttccaaaatgcctgccagaactgagggtctttgataaactgttcaaagtaccgaaatcctacccaatattcaccaaggatattcggacctcccttatagcgtctgaaagcaatgatatttccgactaccggtacatacttgaaaataatgtaatataaaagagggataatcattaaagaatataatctccactcttttttaatatgtctcagcagtgaatgttcttttgtattaactgctatctgacccgactgcggaacctgtacattgtctttctgttttttcatttcattgctcctccctttcaactaaactttcttgtgttccacttgataaaccaattatatcgtacggttagcgcttatgcatttctttttttgccattattttagcaacatgtgcataatacttgtatgtttttatgcattttcccatttggctagtcacatattgctaaaaaatgcccaatttttgctatttcttctggctattttctatatctttcctcataaattgctcacatcttgcgaattaacaccttaataaaaacaaggactgcctgtttttcccatgcagtccctatcttattttttatgcttcgcaaaaacagatactcgtaaagttaaagttgcttcccggaaggaataccagacttacatcgttaactccgtaaatcggttctatctcaaagctctgtttcgtctttgttcccataaattcaaccattctctgttcttcaactccatctttggcaaatttcagaataatcgtattcttttcaagcggagtacttccacaaattacaagactctttgttcctttttcgccaaaatccatctgctcaaaacgaatggtaacgttatttccaatctgatgaatttcttctcctgcacgttcaaagctgtctccgtaaatcttgtcacattctcctgccacaagtatctgccatgcacgattatagcgtttaaaccagaatcctttgatatgaaccttcgcacgaagtacaaagcagatttcgctgattccacgcaatctcttattcaaatggaaagtttctaactgataaacattccacatttttggcttttgataaataaatttgccaagcagactgcctccttcatccggcatgccttcataaatttcgatttcataagggtcatcggtcagtgcaaaaaccggaacggtaatttcgtcagaaccatacacgccaaagtcaatatttctaaatccaacctgactttctccatctcttgcagtcgccactccatgttcattcccgtttccgatttcacctttgctgtagttatataaaccggcacttacaaattcataagggtcggtaaaggcttttccaagtcctgtaataataaattccagggaagaaataatacagatatggtctgttccgctctttgacatacagcgaagtctgaaattcccatcactctttgcggttacttttacgcgaccgtccccgatttcttcagttgttgcaatctttaacggaatccccgcatcatctacaatactccagattaattctttatcttttgcatttgccggactaaaatgtgcttttacgatcgtttcctgattttcttcatgcagatgcagaccattttcgctttccagataaatgtttctcacttccacatcctctgttttttccggttctgcttttcttactccttcataagcaagcagactgattccttctcttacttttgcttcttttaccggaatgaccagttcttttgttttcattcctgcactgctgacacggatttttaaatctcctgctttgtcttttgtcttaaatactgctaagagttttccgctgaataaccttcgacttccggaagtatactgctcggtatcggtactgtctccattatctgttccaactaaaactccggcgccttccgcttcaatccagacacggttgtttgcattttgaaccggatatccgtctttatctctcattgaaatttctacaaataataaatcttcaccgtctgcaagcagttcactttcggatgcgtttaagcagattttttccgcatctttaaacgaatgttgaacatcttctgcgatttcatttccttcttcgtcacaggcaaccgcacgcagttcgccctcttcataaggaatctgccagtgtccggcaagctgttttccactctttgcatctaatgtacagattccctgactcttgccattaaaaatcaattccacaaccggcgcattggagcagactcttacatcaataaactgtccgtcattaaaatcccagtatgggaaaatatgcacaaatggttcttttctataatcgacccatcccgccttatataaatagaaagaatccttaaaaaatccagctgtatcaatctgtccaaaataagaattttttgtgtgatacggagtcggctctccgatatagtcaaatccggtccaaataaactgtccacaggaatacggatgttctgcttctgcctgaatacatgcttcaaccgattttgcaccccagcttgttgtggaatttccaagagcagaacactgctcatcttcatctgtcagtacagactggcggtatgggaaatgatagattccacggctctgtacaatcgaagcagtctcacttccataaatgacccattccggatgatttttatggtggtctgcataatatttctctccatagttatatccggcattttttacgatatccgcacatttctgtgcattttcccacggcatatagttcgaaccaatcgtcacttcggcattgtttctcgggtcgtattttcgtacttcttctattaaaatacgagtccagtactgtcccttatcaccgacatgggtatcataaatttcgtttccgatactccacatcatcagacttggatgatttctgtcacgtttcacccagtttttgacatctctttcataccattcagggaaaaatcttgcataatcatacggattcttagaagattcccacatatcaaaagcttctgtcacaatcaaaagtcccatctcatctgccagttccatgacttccggtgccggcatattgtgagaaagacggactgcattggttcccatctcttttaagagttcaaattttcttctcattgcctttttatgaaaagcagttccaagacatcccaggtcatgatggtcacagacaccgtttaattttacttttcttccatttaataaaaatccctgatttggattcaattcaattgtacggaaaccgacattctgcacttcctgctcaattaattctgttcccttatataaagaaacgattaaatcataataatccggatgttctacatcccagatatccgggtggttcacttttgcctttaaataatgcacataaataccgtcttcttttgttatggtctcttccccggcaagtttctgaatcgtttctgaattttttgcttttaattcataaactacctgcagttcgcttgttgcttcaacctcggcatcaatctctacctgccatacattttcctcttcttttttggctgaaaaataaattccatctgatacaaaatgttccaaaggaagcctctttaaccatacattacgataaattccggctccggtataccaacggctgtttggagtctgaaaagtaatcgatacaaagatttcattctcgccgtcttttaacaggttcgtaacgtctacttcaaatgtcgtgtatccatatttccattctcccgcctgtactccatttacatagatacggctgtccatgtaaattccatcaaaccgaagtacgaccagttcttcttcctcttttgtccagttgaatttcttgtgataccagcccattccgtcttcgtataaattttccacctgggaaatcatccagtcatgcgggattcctactgcataaaaatcctgcatttttttctgtacctgttctaagcttgtctcaaggggctgtttacaaaactcccatccatcattaaataatcgtttcatctgccgctcctgttcctttacttttttctatccgatttaatcttaattctctactttatttctatctcaaacggagctgtcaaaagtccttctttattttttaacagaccatcaagtggggaatccttccatgcataacgcacttttttaatttcttctccaaatacttttactttcgtatcttcaatttccgcttttgccggataaaatactccatctgcttttgcagtttcaaattcatttacgctgtctccacagacaatttccagtggctgtccatcctgtgtatcaaaaataaattctacgccatctgctgttttttcataagaaatcagctttggtccttcactgataatctcttctttgtacatcacttttcttgctgcaagataagcacggtgtgccacaccttttttattaagcggatgcaaatcattgtattctcccaaatctaagtttacagtaactgccacatccggaagttctgctgcatttttctgggcttcacgaatgactgcccatgcgccgtctccacggttatccattccacaagccggaagctgaatcacaataaacggcagttcttcctgtttccaatgtgctctccagttcaaaatcatcttctgaatcaaatcttcataactttccggataccactcattggattctccctgataccacagcactccttttacggtcatgttggtacacggtgcaaccattccctgatacattccggttggctgtcttgtaataaaggtaagtatcggagcctgttcgctgactacacgcacctgatagtcccatgttccacgaaggctgattttttctcctgattcaaaacatacatcacaaggtttatccggagtgatacgaccttttccgtcacgacactccagacggataaagatttcattttctcctgcctttaaaagtccctccggtaccggataaattcttggcggaaaacaataaccggtttctcccaccttttctccgttgataaagatacggtcactatccacaagcgttcccatttttaaaattgcagattttcctgccagttcttttggcacttcaaaagttctctttaaatgtagtaatccactgaagttttcaagtccctgtttatcaaaccagcccggaacttccaagatgttccacggtgcatcctctgtctctgcctctttctttgaaagcagttcatgccatgcattttcttttttatcctgtgcactgagcagattttcaatatatccgtcttgtgcaaaacgctcttttacttctaaaaactccgggtaatctgccaaggcttcttcactcatccatgcttctaccggagttccccctttgctgatgttgataattccgaccggaacctgctcttttttctgaatcatatctccaacgaaatatcccagtgcagttgtctcttctagtggcattcccacacattcattccagcctgcttctttatgttcttttaatgcccctgtaaacaccggacattcttccactttatactggtgtaccattgcatttcccggttcatccggaaacatttcacgcactcttgtaatcggaagttccatgttagactgtccagagcagacaaatacatctcccacataaacctcttttacgactgtctcctgtccatcttcactttttatgctcaacacataaggaccacctgttttttcacaggaaatttctgtctcaaatgttccttccgcatcacatttggttctgtaaactttctcctgaaatgtaacctcaagctctgcctgtggtttgtaccatccccaaattcttgttttttctccacgctgtaatacacagccttcctgcagaagttttggaagtttaattgactgactcataacggtctccttttttctactctattctgaatttactcgtttctttattttacccttatcataaaggattccctgtaaaaattctcccttaatgttgccgagtgtttcccgattcttgctttctttttatacaacaaaaataagaaccccgaaaatgggattcttattttttcctgcacatctcatcggtactgctttttccacgatactccgatggtgaacatccttttattgatttaaaggtacggttaaatgcactaatcgaagaaaatccggagctcattgcgatttccgtcacactttctccggtcgtactaagcaattcctctgcctttgaaatccgcttctgattcagatattcatagaatgtcatattcatacactgcttaaaaatccttgtaaaatggaacttggaaaatccactgaattctgccacctcttccaaagaaagagcttcctgatagtgctgattaatataattacaggcactcataatcgtttccatatattcctttttcttttccggattattttctgtgcgcaaaacctgatttttattctttcgacctccgcttataacatttcgtccgatatgtacaaatatttcaattaattttgcgtaaatgactgcattaaaaaatgccttttcctcatcatactccacaataatggaatccatctgacgttttacaaaactgtataatctctgcgtgtcttcttcctctgataaatacagcacaggcggaagcacatttaacagtgtctccatttcttttaacgaatataataagtagtcactgaattgtaaaataatacgttccccagttggcggtgcttccaatccatgcagtacacccgggttgataattaaaatatctccttcttttaaacaatactttttacttccgataatcacgttatatccttcatgaatcggcataatgatttcaattgcagtatgccagtgctccgggtaatcctcgtagtctacattatgaaacaatctaagtcctaatggattaccatagttgattgtctcgtgtgttccctctaagatttctatcatccttcgtatccaccatccctatctcatctttatagattttgttatcaggttctctataactagtatactagcatggtagttttggaaattcaaggtacttttttcattttgcacgcaaaaatagagactgtagaacttctccacagcctctatccatagcctattcaatttttaatctttcattcttaatcttcatcagagaaatccggttcaatcagaccatacgtgtttccttttctcttatacacaacattaacctcttctgtctctgcatttaagaatacaaagaaattgtgtccaagtaattccatctgtacgcatgcatcttccggatacattggtttaaatccaaattttttggtacgaatgattttaatttcacttgtatcatcttcgtagtctttttcaataaattccggctggaatgtttccacgttctgtttcttgttaataatttttgttttgtattttcttaactgtctttcaatgatttcttctaccaggtcaatggaaacatacatatcattgcttacctgctcagaacgaatgatattaccttttactggaatcgttacttcaattttctgacgttctttttctacacttaatgttacaataatttctgtatccgctgtaaaatatcgttccagttttcctaacttatcttcgactgctgttctaagtccgtccgtaatatcaatgtttcttccgcttataataaatttcatgctgtccaacccctttaacgtgtattttacaggtgttttactttcgttcctgtaatgtaaatctattatatcaatattcagtcaattattcaacagtttttagaaaattttaactattttatcttttttgtatacatcattattatgtaaacacagttgcagtctgattgcagctgtgttaaatcttctttattgattatttttattgttattcaaattattgttatcattattattgttgttcccgtcttctgtcaaatcattgatgccgtcttttaatccttcaccgatatcttccacgccatcaccgatgtcttctccaatatctccgatgacaccgtccccattattattcctattattatcattcctatcattattcatagtatcatcattcgtcgtaccattatcatttgtcgtactatcatttactgtatcattttgatttccgcctgtcgcatcattcatgttatttccacatgcggtcataacaaccatcattcctgcaagcagtaaagtaaatacatattttttcatcgatttcttctccttttcctgttgaaaataattttcctgcttataatatgcgacaaaaaccggatttttatgttttccggcaacaaaaaaatgccaggaaaaatttcccagcattttttatatcaatacgctttttattttcagctaaattttctattctatcagccgataacatcgctcatgtcatacattccagcaccttttcctttgaggaattttgctgcttctactgcaccttttccaaatacagcttttgagtatgcagtatgcttgaactcaatcacttcgtccggaccacagaataacacttcgtgttctcctacgattgttccaccacggactgcggaaattccgagttcttttttgtctcgtttctgtcttacctgacttctgtcatagatgtattcgtactgattgtccattgcctcattgatactgtcagccagtgcaagtgctgtaccgcttggtgcatccaatttctgattgtgatgtttttctacgatttctacatcaaatcctgctgctgcaagcacttttgaagcatcctgcagtaattttaaaagcgtgttgattccgagggacatatttgcagaacgaagtactgctgtttcttttgcagcttctttagtctttgcaagctgttcttcagaaagtcctgttgtacacagtactaatggaagtttctttttcgcacaatactccaataccttatctgtcgcttttgcagatgaaaaatcaatcattgcatcggcctctacatcacatgtatcaatatctgtaaacaccggatatccattgtctctgttatctacaatatcaattcctgctacgatttctgcatctgcatctttttcaaccagaccactgattacctgtcccatgtgaccgttacagccactcataataattcttaccatctttcgttcctctttttcctgtattctcatgctactacagcaaatattaagtaatccacttattgttttgccttaattttcgctgtattacttgataatttcgagtgataccactcggtctgctgcttcttttaatttcggagttacaacatttcctgtcaaaatcatttccatctcctcatcttttgcctgtatcaggttgacgacatcatcatctgaaatgattccaaactccacagcacctaatacttcatcaagaatcagcatgtcacattcctgtgtcacaagaacttttttcgcataattcaatccgttacggatattgaagttctcttcctgacgctcttcttcggtcagatcctcataacacttgttctttttttcaaatcggaacaattttacattcggttcaagaaccgaaagataatccacctcggaagtcgctctgcctttcaaaaactggattacaatcgccgttttaccatgaccgattgctcgaattgcctgcccaattgccacacttgttttgccttttcccgggccacaatacacctggacaattcctttgttttccatatttacacctcttacagattcgatatagacctttttcctctgtttcttgcgttttccacatgctgtgtatatcttactacacctgaccaaagattgcaatccaaattcctgtccggcaaaacttctctgtttttattcattcagcaggtctgtatctccataattttctccgtactccaatttactgacagaaacttcatacgcagttcgcttttctgtctcggtttcacttaatttctttatatattccctgctctggattcttccccagatatggagacgtcctccaacttcaaatgaacgggcaaaatttgcatttcttccccaacagatacagggaatataatccgattttccataaggacggttcactgccagaagcacatccgcaatctctcttccaagcggagtcattctgtgaaccggcggcttacatatgtaaccgttcaattcaatcagattcgtctctactgaatcatcttcttcctctacaaaggtaagttctctaacaaataccgacaacaccagccggttcttcttttcttcatgtctgttataggaccgaaactgtccctgcacctgtatatattcacctaagtaactttgcgtaacatccaccagtctttctgagaccataagcggaattctgtcctccgaaccacttaagcgtttcaccaaaatgtctaccatgtaaaagccctccccatatacttcgtggctctttacaaactctgatgcaactacgcccaccattgatacctgattgttttcaataattttatctgccatgaatcactttccccttcctctttttggtattttatctttattaatctattcatgagagtggggatttattcctgtttttttatttttttttgaaaaaatttttgaaaactaaattttttctttgtatttacggctaattgtgatagaatggcttgtgattaaaaatgttttttacggtttctaatgtgccatttactattttatataggtacattctatttggaaaagaggttattatgaaaacaaaaagagaagatatcagaaatgtagcaattattgcccacgttgaccacggtaaaaccacccttgttgaccagctcttaaaacagagtggtgtattccgtgaaaaccaggaagtgcaggaacgtgtcatggactccaatgacatcgaaagagaacgtggaatcacaattctttctaaaaatactgctgtttactacaaagatacaaaaattaatattatcgataccccaggacatgcagatttcggtggcgaagtagagcgagttttaaaaatggtagacggtgttatcctgttagttgacgcctttgaaggtgcaatgcctcagacaaagttcgttttgaaaaaagcccttgaactggatttacatgttattgtctgtatcaacaaaatcgaccgtccggaagcaagaccaaacgaagttatcgatgaagtcttagaacttttaatggacttagatgcatcagacgaacagcttgactgtccatttttatatgcatctgcaaaagcaggacacgctgtacttgaccttgctgacactcctgaaaatatggaaccactctttgaaactatcttaaaatatattccggctccggaaggtgaccctgaagaaggaactcaggtactgattagtaccatcgattacaacgaatatgtcggacgtatcggtgtcggaaaagtagaaaacggaacaatccgtgtcaatcaggacgttttacttttaaaccatcatgatcctgataagaaaaaacgcgtaaaaatcagcaaactttacgaatttgacggacttggcaaaaaagaagtaacagaagccagctttggttctattgttgcaatctccggtattgcagacattcacattggtgataccttatgttctccggaaaatccggtggcaattccattccagaagatttccgagccgacaatttccatgaacttcattgtaaatgacagcccgcttgccggacaggaaggcaaattcgtcacttcccgtcatttaaaagaacgtctcttaagagaattaaatacagacgtcagcttacgtgtagaagaaacagaaagcacagactgctttaaagtttccggacgtggagaacttcatctgtctgttttaatcgaaaacatgcgtcgtgaaggctatgaatttgcagtcagcaaagcagaagttatctatcacgaagatgaacgcggtaaaaaactcgaaccaatcgaaatcgcatacattgatgttccggaagaattttccggtactgttatcaaccgtttaaatgaaagaaaaggtgaactgcagggcatgagtccggcaagtgacggaaccgtccgtctggaatatcacattccatcccgcggattaatcggtttccgtggagaatttatgacctccacaaagggtaccggtatcatcaatactgcttttgacggctatgcaccatacaaaggtgatatgaactacagaaaacagggttcattaatcgcttttgaatccggtgaagctgttacttacggactcttctccgcacaggatcgtggtactttatttatcggacctggtgaaaaagtatacagcggaatggttatcggacagagtggaaaatcagaggatattgagttaaatgtctgcaagaccaaacatctgaccaacacccgttcttcttctgccgatgatgccttaaaactgactccgccgagagtgttaagtcttgaacaggctctcgaattcattgataccgatgagctgcttgaagtcactccgaaatccctgcgtatccgtaaaaaaattctggattccagacttcgtaaacgtgacaacatgaaaaaatagtaaaatcggagcattaaatatcgaataaaactcccaaaaaagagaacatttccaaccggtaatgttctcttttttttacttttttgatacaggtcaagcggatattcgcaatccgcttcgctacttgctcataaccaaatagctgctacgcagcttatcagaaggggcttgccccctcctgatacaagcaagtccccacccctgcttattgctttttgcaattgaagcaggggacttccttgatttggttaaatttttaacatttttcagaaaatttcgattattttttaacaattcttgcaatcacttcgttactatgctaaaataatttcataaacaaatggtttttatatgcaaagcaaccaattttattttaggaggtctctgaatggcaaaaaaagtcgaatccaaagtacctgaaactatcgatagcgtagaagcactccagacaaagattgctgctatgagagaggcgcagaagaaatttgccacgtttactcaggagcaggttgataaaatcttttttgaggctgcaatggctgcaaacaaacaacgtatcccgctttccaaactggccgtggaagaaactggaatgggtgtcgttgaagacaaagtaattaagaaccattatgctgcggaatatatgtataacgcttacaaacgtgtaaaaacctgcggtgtgattgaagaagacaaatcttatggaatcaagaaaatcgctgaaccggttggtcttgtaggtgcagttattcctaccacaaacccgacttctaccgctatcttcaaatgtctgatttgtttaaaaaccagaaatgcaatcttaatcagcccgcatccgcgtgcaaaaaaatgtaccgctgaagctgcccgtatcgttttagaagcagctgtaaaagcaggtgctccggaaggaatcatcggatgtatcgaagagccgaccatcgaactttccaatgaattgatgaaagctgccgatgtcatccttgcaaccggtggtcctggaatggtaaaagccgcttattcatccggaaaaccggcaatcggtgtaggtcctggaaatactcctgttatcatggacagctcctgtgatattcctaccgctgtttactctgtcatccattccaaaacatttgataatggtatgatttgtgcttctgaacagtccgttactgcaatcgctgatatctatgatgcagtgaaaaaagaatttgtcaaacgtggatgtcatgtactgaacaaaacagaacttgaccaggttcgaggcattctcttaacagaagcaggcactgtaaatccgaaaattgtaggacagccggcatacaagattgctgctatggcaggtgttactgttcctgctgatacaaaaatcttaatcggcgaggttacatccgttgatgtttccgaaccatttgctcatgaaaaactgtcccctgtccttgctctttataaagcaaaagatttcgatactgcacttgatatgtcagaacagcttatcgcagacggtggatacggtcatacttcttctctgtatgtacatccatcagaaactgaaaaacttgccaaacatgccgctcgtatgaaaacatgccgtattctggtaaatactccgtcatcccacggtggtatcggtgacctttataactttaagcttgctccatccttaacattaggctgtggttcttatggtggcaactctgtttcagaaaacgtaggtgtcaaacatctgctcaatgttaaaacagttgccgaaaggagagagaacatgctgtggttccgtgcacctgaaaaagtttactttaagaaaggctgtctgccggtagctcttgatgaattaaagaattattatcataaaacaaaagcatttatcgtaactgatactttcttatatcagaacggtcataccagaccaatcaccgataaactcgatgaaatgggtattccttatgactgcttcttcgaagttactccggatccgactttgcagtgtgcacagagaggtttagagcagttgaaagcatttggtcctgacgttatcatcgctctcggtggtggttccgctatggactgtgcaaaaattatgtggatgatgtacgaacatccggaatgtgcatttgaagaccttgctatggacttcatggatatccgtaagagagtttacaccttcccgaagatgggtgaaaaagcaatgatggtttccatcccgacttcctccggaacaggttctgaagtaactccatttgctatcatcacagatgctacaacaggaacaaaatggccaatcgcagactatgaactgcttccagatatggcaattattgacgctgatttcatgatgagccagccaaaaggactgaccagtgcttccggtatcgatgctctgactcatgcgctcgaagcttacgtttccattatggcaactgacttcacagacggtatggcattaaaggcagctaagattatctttgattatctgccatctgcttacgataaaggagcagctgacccaattgcccgagaaaagatgggtaatgcatctaccttagccggtatggcatttgccaatgcattcctcggtgtctgccactccatggctcacaaactcggtgcttatcatcacctgccacacggtatcgcaaacgctctgttaatcgagcttgttatgcgctacaatgcagacccggcaccggttaaaatgggaaccttctcccagtatccatatccacacgcaaaagaacgctactgtgaagttgcacgttttgtaggtgtgaccggaaagaatgacgatgaagtatttgaaaacttcatcaaagcaatcgctgaattaaaagaaaaagttggaatcaagagaaccattaaagattacggtatcgaagaatctgctttcctcgctacattagacgaaatggttgaaaatgcgttcaacgaccagtgtactggcgcaaacccaagatatccacttatgtctgaaatcaaagatatgtacttaaaagcttactatggtgaataattgaatcattgttaccgcttattcacttttcgttaaatttgaattactcctttcgcgctattacctaaatagcaaaacgaccgctcacagggaaacctgtgggcggttgttttttcttgtcataataaataattgttttgattttttctttactcgacctgctgttcgccttctccgaagtaataataagcattaccactctgaagggtttttccttttgcttctgccagttcactgacagtcacaagtttaaatccttttgcaatcaaatccggtatcattcggattgccgcttttaccgaccattcatgaatgtcatgcatcaatacaacggaaccgtcctgtgcattatccataacaacctgataagtctgatcctcactcttggttgcccagtctctagtatcaatactccagataatcagcggatgatcaattgctgctttgacagaatcgttgaaagaaccacctggcggacgcattacggttgcctcaaatccagttgcagcttttaatgctgcatccgtattgcttacctgctgtgctgctgcatctgctccaattgtcaccaaatccggatgactgtaagaatgatttccaagttccattccagcatccgataattcctttgcaatttccggatatgcttctacattttgtcccagcatgaagaaggttgcttttgcattattttctaccagacaattaagcaattcttcggtatactcacccggaccatcatcaaaagtcaatgcaatcattggacgctgttttgtctcatcgtattttccatcttcatcaaaatagcagtctttgtcatcaattgtctgccatcctgtcaggatataaccatttgaattaaaataatatgtactgccatttacttcctgccagccatcctgataataactgccatcccgattctgataccaccagccgttttcatcctgatgccatccaatacttggcgctgcctttaacttatctacatcagaagcactcatgaccggctgttttcctgcctcaccggtgtcttctgctgcctgaacttctacggtactgctgtttgcattcttagcactactgttttttatatgaacaccggagaacagctttccaactcctcttcctgcaaaaaccaatacgaataccagtacaactgccattgcaccaatccgcatcatttttcttcgacgtaactgacgtatcttttcctgcttacggcgcatcattctctcatgtcgaatacgctgacgctctagttcgtctctttgttcttcgtccatttttctttatccctcatttccttttcacactcaaatcctttgttaatcataccttttttttcgacattatgcaacctctacactcttaattttcctttacaaaagtgttacaaatgaaaaaagagattagccattttctgactaacctctttctactgttttttcaagcagacattctttgacagttcgaactaattcattcatttatttattttctaatttgcctgtacttctgcgctttttactttcgctttctgttttccaaaaaacgcttttgtctctgcaaatacaaccggacttaacgcaatcagtgcaattaagtttggaaatgccatcaatgcattaaagatatctgcgatattccatactgcttctactgtcatgtaaggtccgataaaaattgcaagaatatataaccagcggtatccttttactacttttttattacggttgaataagtattcaatacatctttcaccatagtaattccatccaagaattgtggtaaatgcaaagaataccaaacataccatcaatactaaagatgcaacagccggagggaacgggagtcctttctggaatgcagctgttgtaattgccacaccttcaagaccagtattccatgtacctgttataacaatggtcagacctgtcatcgtacagattacaatagtatcaataaatgtacctgtcatagaaaccagaccctgacgtacggtagaatgggtctgtgctgctgccgctgcaatcggggcactaccaagacctgcttcatttgagaagataccacgtgcaatacccttctgcattgcaactaccatcgttcctgccgctccacctgccagtgcgcttcctgtaaatgcactctttacgattgtgacaattgctgccggaagtgctgtaatatgtgtaataatgacaataaaagcaaatacgaaatagatgattgccataaatggcacaacaacctgtgaaacacttgcaattctctttaatccaccgataacaaccagcccaacacatactgtcagagccagacctgcaatgattgttgcgatagagtaatctctgccaaataatgcgatagtgtttactttatccgggtcaaagaaattacagactgctgaggaaattccgtttacctgtgtgaatgtaccgattcccagtaaacctacacccgcaccaaagaatgcaaacatttttgcaagccatttccattttacacccataccattttcgatatagtagaatggtccgccaagtacatgaccttctttatcgatagtacgatatttgattgccagcacaccttcggaatatttggttgccattccaaaaaatgctgcaacaaccatccagaataatgatcccggaccacctgctgcaagtgcggttgcaacaccgacgatatttccggtaccgattgttgctgacattgcagtacaaagtgcaccaaaactgctgacttcaccttttccgccctcttcattttttaccataaatttcagggctttgcccaggtgccggatttgaagaaatcccatgctgacagataaataaatacctgtacataagatgagaataatcagcggtaatccccataccgctccgtcaatccagctgattacattgttcattgtttcaaacatttcttttacgtcctctctttcttttcgatgcaccactttggtacatttcctagaacctctcttgaatttttcagttcagaaaacaaaaaaactgtggaatcctcattccacagtctcataagagtacgacaaaacatatacaagataacctctgtatactctgtccttttgcctgagagattaacaacataaatgttgccgtacaccttcggcgctcttacttgagactctccagagtgttgtctttcgacaacgtttactatagcatattcccgtgctgaatacaagtgtttttttatgagagacatttttctaaaatctgctcaaactacagttcctgtttcttgacattttattcgcacaaattgcatagtcattcccgatttcctgtgctattatcaaagcatcatcacttactttataatttattaatttttcatgtaaaggagcattaatcatgttaaaaaatacgtttaaaaatccacttctttccggattttatccagacccgtctatctgtcgtgtaggcgaagactattatcttgttacttcttcttttgtttattatccaggacttccgattttccacagccgtgacctggtacactgggaacaaatcggccatgcaatccatcgtccggaccaattagattataaaaattgtgagacctctttaggattatgggcaccaagcatccgttaccacgaaggtacattctatattatcaatacttttgtgtccgagggcagagaagccagacgcgataactacattgtaaccgcaaaagacccggctggtccatggagtgacccggtatttgtagagggtgcagacggaatcgattccagtctgtttttcgatgaagacggaagcctctggtatgtgggaaactttatcagtgaagaatgtcgttatgagggacaccacggaatctatctaaatgaattagataccgaaactttccagtttaaaggcccacgctacattatctgggatggtttcaaaaccagaagtaaatggattgaagctccacatatttataaaaaagacggctggtattatctgctggttgcagaagggggcacatttgtaaaccacagtgtacagatggctcgctgccgtaccatcaatggtgactatgaaatctgtccgagaaatccaattattactcaccgtcatcttccgatcgaaaatccgatttctgttaccggacatgctgatattgtggaaactcagaatggagaatggtggatggtacttcttgccgttcgtccttatgtcggaggtcattacaatctcggacgtgaaaccttcatggttccatttgtatgggccaaagatggctggccgatgattgacaatgaaaccggaatggttcagaccgaagaacgacttccaaatcttccaagaaccattctgcctctgattccgactaccgataattttgaaagcgaaacccttgcaatgcagtggaataccattcatccgccggtagaaccattttattctctgacagaacgtcctggatttctacgtctttccacccgcccggaagtgcttgaagaaatctgtactccatcttttgttggacgacgccagcagcataaaacatttttagcccgcactgccatggaatttattccacagacagaatcggaagaagccggtgttgcgattcttcaagatgaccgctttaattacattatggttctaaaagaaaaagacgatgaacttgtgctcgagcttcacaaaacagaaaatggaacaagaagtctcattacctctgctcctgtaaaaagaagtaaacgtctgtatctttctattcagggaaatgtaaccgactacagcttctattatggatatgacgaacaggaaatgactttacttgcttcaggtcttgatgcttctcttttaagctctgttgtaaacgaaggatttaccggtgcttatatgggtatgtatacaagctcgaatcataccgaaagctttaaccatgctgactttgactggttttcttatcagggtgaataattttaatttttgcctctgcaagtaaaacatacaaaaaatggcccacagaaaaaactctgtgagccatttttttatttaaacgcttctgctatctgttgtaccagagcgtttacatctgcattttttaccagatatcgttccgttccattgactgcaacactgtcataatttccatcataagtataatacgtcagtgtaatttccggtgcttcttttgtacttctgtggaataccatacgcagcacttcttctttttcattatccgccttcggagtatctaaattagaatccagcatcacattcaacaatgcctgatatagggttgtaaaggtttctttttccacttctttatcgcccatataatattttccatctttgattttcattgtataagaagattcttttgtcttgatgtcaatactttctacggtatcaatatttacaagtgccggaatttttaagatataatcaaacggatttaagttgtaaattgcttcaagtgtactggtaggaattgtatacacttcattttcatagcctgctactgccacataacgatttccaaggtcatcttcatttccaagcagtaaggtaaccgtcttatctgcttcggcagaggtatcagtactctctgtataatcaatctgcatcgttgttgtacttcccgctacaccagtatctgttccatccggaacttccgcagttgttgaaaaatcaaatccgcttaacacatcaaacaatttatacatggtttccgtatttacagtcgctgtctcatcgtaaggatttaaaatctcccagtaatcaaactccatcttgtaatcggccggttcttttgacaaagagaaaatttcttctccatctcggttaagtacgagtttacggattccatcagaagtaaaagtcgggtgttctgtcttttcaagttctactttcttttcctctgtcttttcctctgtcttctcttcggtttccgttttttcctcatctgcagcttcttcggttttttcttccgcttcgccattcgtatcttctgtattttctacttctttcgtgccttctttttctgttttatcttcgctttcttctgcttttgtctctgttttcgtttcctttgtttccgttgtctgcttctgacatcctccaagtgtaaacatacttaatgatgctataattcctaacaacgcaattttttgcaatatttttcgcatattctttttgtccatcctttcttacccttttctattctgttactttttctttaatttctctaaaaaggggaatctcttcggattcccctctatactagcacgttctcttttaaatggcaaaatcaatttttaccgatttgcatctcccttaaaatctaattaactatttctgtcacttcacaggcttcttctcttcccgccagtaccagatttttagaaaaagcctctctgatatcatggcagaatccaccaactctattgacacacccctctctaaatggtacgattttcacaaataatcacaaaatttttagagatgtaggtgaaaaatatggactatcaaacacaaatacaaagctttacagatgagcagcttgcaactcttatcgacgatgaaactgctacagaaacacttggattagaagctgataaaatacgtcgggaaaactatggaaacgaagtctatgtacgtggtttaattgaattttcaaattattgtaaaaatgactgctactactgcggtatccgaaaaggaaaccggaaagcagaccgctaccgcctttcttttgacgacattttatcctgctgtgaagaaggatttgctctcggtttccgtacctttgtactgcaaggtggagaagacccgtggtacacggatgagaaagtctgtcagattgtttctgctattaaagaacgctttccggaatgtgccgtcacgttatcgattggagaaaaatcaaaagaaagctatcaggcttatttcaatgccggtgcagaacgctatctgcttcgccatgagacagccgagcctgaacattatcagaaattacaccctgacagcatgagccttgaaaaccgcaaacgctgtctctttgatttaaaagaaatcggatatcaagtcggttccggattcatggtcggctctccttatcaaactgccgaaaatctcgtttcggatcttcgatttttgcaggaattacagcctgatatgataggaatcggaccttatattacccatcaggataccccgtttgctgaatttccaagcggaagcctgactaagaccctgcgtctggtttcgattttaagactgctctttccttatgcactgattccatccaccacggcacttggaacaattcatccggaaggacgagaactcggcttaaaagccggaggcaatgtcgtcatgccaaatctttctcctgtctcggttcgtaaaaaatacgaactctatgaaaataagatttgcaccggagaagaagctgcacagtgccgaggatgccttgaagcaagggtaaaaaaagcggggtatcagattgtaacggcaagaggtgatgtaaaaaaacattaaacataagggacggagttcgtggcaaacgccataaattccgtcccttatttcttactgcagtgcctgaagcatctgaagcattgtcatttttgtaattggatgacgtttccacggtgcaatttctgccattggaattaatacaaaatcacgtaaatgcatttcaatatgtggaatatgtaaatccggtgcatcgattacttcgtcatcatagagtaaaatatctaaatccaaagtacgaggtccccagtggatgattcgttctcggttagcatccgcttcgatttcatgaagcagatcaagcagttcataaggtggcagcagagttttaagttccaatgctccatttaaaaaatcatcctgttccactccgccataaggttcggttacaagataatcagaaacctgaacaacactgcagtcctctgctgcatcaagcaaggcaaccgcacggtcaagatatgcttttttatcacccatattagagccaagagcaatataggcagtatgccagcttctgctgatttcgactgaaacggtatcaagtggaagattgattggtgcccatggtttttttactgtaatatctacctgcttcacaagagtagaataagtgactaagattgtatgagcaacttcttctgcgattttttcaattaaattccaagtatttccctctacgattttttttatcagatgggacacttccccatagttaatcgaattttcaaggttatcggttaagcctgccatgcgggtgtctgtgtgaagaactgctgaaatcacaaatttctgtcccagaaaattttcctgctcatacacaccgtggttggcaaatacttctaaatctttgacagttatcttatccataataagttctccgattcgttattagtgagcaagaattgcttttgtcatctggatgatacgtttgttttctttgatatcatgcacacggacaaatgcacagtttttcatcacaccgattacagttgtggcaagtgttccttctacacgctggtcagccggcagattcaacgtatttccgattacagattttctggaagttccaagtaaaattgggaaaccaagtctgtgcagaacgtctacatgattgattgcagcgaggttcatttcataagtttttccaaatccaacacctgggtctaacatgattttatcatcagcaactccggcttctcttgcgattttaacacattcagccatctcacttaccatgtcttctaagaaatcattgtaaactgcttcatctttgttatgcatcagacagcaggctgcattatattttgcggtcataagtgccgtttttttatcaaatttaaagccccatatatcatttacaaggtctgcgcctgcctgaagagcagcttctgcaacatttcctttataagtatcgattgataccggaacatcaaaacgagctttgacagcttcaataatcgggacaactcttgcgatttcttcttcttctgaaattacgatatgtcccgggcgtgtggactctccaccgatatctacgatatctgtccctcctttaatcatttcttctgcatgatgcagagctgcatcaagattattaaattttcctccgtctgagaaagagtccggagttacatttaaaatccccataatataggtttcattttttacatcaaattcacgatttccgattttcatagtcttttatctccaaatttagtatttaacaaattcgttctaataaaacaacgctaaatttttcttggtatccggccagttacattctttgattgccggacatgcaaaacagttccgagactgtttgtctgcacggtaaagatattttgcaagaagagaatcctcctcagaagattcttttctgtgaccggcgatggcttctgcaacctgtataacttcttctttagagaaatcacagaaagtcataatttcatccgctatcctcgcaccggaaatatggtgtggagtaccaagtgaaatctgttcatagcgtccgatatcatgcagcagggctgccgcatagatcagttctttacttacgtttgttttttcttctaaggtatagatgtacatcagtcttgcaacatcaacaaaatgttccattgtatgacggcagaactcacgatctttttctgcatcctgtaataatttaaactgttcctgatacaatggatgatttaaaattttctggattcgttccataaatgaatcaaccttttaccatctggaagaaagtctgctgaaggttaaagtcttctgcaaaagcaccgcgaaccatagttgttacggttttgcttcccggtttctgaactccacgcatggtcatgcacatgtgctctgcttcaatcataaccataactccctttggctgaaggtgttcttctaatgcatctgcaatctgtgcagtcatattttcctgaatctgtggacgtcttgcaaatacttcaacggtacgggcaagtttgctaagaccagctactttttcatttggaatgtaagcaacgtgtgcttttccgtagaatggaagtaagtgatgttcacaggtagaatagaacgtaatatctttttctactaccatattgttgttggttgcatggaactgtttttcaagatgtacacctgcatcttcataaagtccgccgtaaatctgttcacacatgcgggcaatacggtccggtgtctctaaaagtccttctctgtttacatcctctccaataccttctaataacaggcgaacgccctgtttgattttctcatggtccatcatttctaaaaatcctcctctaatataaatgaataatgtttcgggatgtaagacaagaaaagtttaaaagacacaaaaaaaacatcccgatgtgaataagtcatctggaataaataataatttttatatcccttcacaatcgagatgttgctgtcatctgtgtgttgcaacgggtgcggactccatatcgtaagacgagcttttcgtttctgcggcaactccccatccactgaacacttaacgcatagaatcctattttgcatattatttatctgcggctattatagcatcgagtacagaagaaagcaatagaaatccgtagtttgcaggggggttttggaaggtttttcctgtttatgtaaaattcaaaagaagggaatgtaaaacaatgagacaaagaatctgaaaattaaataaataagtagaaatagccgctaaactgttggtatgatataatattaatgatataatattaatatagaaatctaagaaaactatttgcgtattcatttttttaattctttcaaggaaaggggaaaatgtaatgaaaaaacagaacaaatcctctattgtatggtttattcttagcgttattgcaatgattttcttgacaatgcgagttgcgatgaactgggaattgaagggtgcagtattggtgttttttatttttggtatcgtaatagaaattatctggatagcaaaaaatataataaaattttttcgagaatatgaataaaaagcctcctgattttagagtcccaaaaataaatgggccatcctcaaactagattagcccatttattttttatttttctcgatttgccaattcttctgcaatctgtggcatttcacggtctaatttataaatcaccagcataattgctgcaatcacccaaatgatgaccggtccccatttatagatatcagcaatcattgaaatcgcacttcctggctgtactacatctgttccctgtgaactgatgtatccacttgcagtcattaaagaagtaatcactgcacttgcaattcctgaacctactttaaatccaagacttgcgcctccaaaaatcatgctttcctgacggaaaccatttttccagtaactatactctaccacatctcccagcataccaaatactgtcgcatttagctgtgctacaccggctgaacgaatcaatgtaatcgcaaacatatagtagaagttgtttggatttagcataagacatacctgcgctgcaatcgcaactactgcaccggcgagtgtaatatttcttttcccccatttcttgataaacacaggacaaaccatcgcacccaaaataattacaatcgtctctgcaaaatataatacactgtacatccatgaatcattatggaagatatatttacaataatatggaaggcttgtaccaataattgtcatgtgagtaacctgaactgtccacaataccagtacacaccagaaatatttatttttaaccaatgcttttaagtgagtcaataccgggattttttctactgtttttttctgctctgttgttatagtttcttcacattttaagaagcagaataagagtaatgccatagcaatgacaacccataatcccattgttttaatccatgcagcctgatcatttccaaataattttacgattggcattgtaaaagttacagaaataattcttccaaacggagaaataatcattctgaaaattgataataaatcctgctgataagaatctcttgtcattaatgcagataatgcgccataaggtacattaattgtgtcttataattaatttctcctgttcccggctcatgacgtcccggtgcatctgcaacgtgaatatgaccaaactgatctccataatttgtaatggtgtcgcaaatacagctttcattaatctgcatatgataaatatcataaagtacttttaatcttggtgaaccgatcagacgacaaatttctgctgccatctgtgagcacttggacttgaaaaagaaatcaaagtaatctgccatgacgttgctgctaacacaaaacttttattagaagatggaagtattgatttcacaattactcaaaatctttatcgtcagggttacctgccgattatttacttaaaagaatatttaaaaaatgatacccttccagattctacgaatattacacctcatatttctattatctgttcgcaaaatatttaactcagattcaacacttgtaagactcatcgcatgattacaaagaaaaaagccatcttttttaatttttttaagatggcttttttctttttcacaaatttttcacatttttcctattttattttttatttgtagtgttataatacagatagtgcatatagaacttctgttatcacatcttctatacctacacgaataattattttgatttttcaggaggaatagatattatgactacattaaaaaccacaaaaagaaatccggaagtaaaagcaaaaaaattaagacgtgacggttttgccacaggtgttctttacggaagagaaatggacgaaaacattccgcttcagtttagtgcggtagacgccagccgctttatcaaatcacataaagaaggttctcaggttatccttgatttcggagataccaagacaagcgctatcgttaaaaatattgattacgatgcaatgaaacgtcaggtaatggctctggactttcaggcactggttgccggggaagcaatttctacgactgttccggtaaaactggaaaatgaaggcgctgttcagggatttgttgaccaggaactgactgaaattcattacaaagcagaccctgcacatctgcttgagcctattgaaattgaccttaccaaattccacacaggcgatgctctgtatgtaaaagatttgggtctggaagaaaaaggtgctcagcttatcacaccggctgattccttaattttccacattgcagaccatgctaaaaacatggaaattgctgaagatgaaacagctgacgaagaagctgctgaagcctaagtagtaaaatgaataaaggacggagtttatggcgtctgccacaaactccgtcctttattcatttttttattaaatctccaccttttctaccctccacttcccatctttcagatataaaagagccatcgacggtgcatcgaaaaatcttttttccccacaactgcctggattaagccaaagccttccctctttttctctttcttcatatttatgagtgtgaccgtaaatcacaatctgcgtttcttctaaattccaaggcacatcttttttctcatgtaccacacagaaattgactccgtccagtgtaaaacgctgacattttaataagtgtgacgcccatgcgccatcattatttccacgtataaaatagacgggtactcttggctttaaatgtataaaaatctcatctataattctctgagaaccgatatctcctgcatgaatcagcgcatcacagctttcaatttgttcaagcacttccggtcgtaacaatccatgcatatccgatagcactgctattttcatctaattactccttttctgttttctttttattttaccataataaaaaagccatggactaatattttgtccacagcatttttattttttctgctatctgttgtaatttctgtccacgatatccaaaaatcctcactgctaaatctccactgcaaagctttgtcacaccgccgtcacattctgattccatttcaaggatttcccagattctttctgtaatttcagacatcacttttccgtcctcaagttcggataaaaacaggtttgccacatgcgtatacccttcatacagaccaattttttccatcggcattttttctggttcatatctggtattgtcccggtaaatcatttttccacttcggtaaatcgtcacttttgaagcaaactttcggtataaaaagcgttcttcatgtgccgttcttccacaggaaatcacatccagaaaaaagagttttgcactcttatcttccagttgaatctccatcgtactctcgaaagcagaatctgcaaatggaatcaccggctgaggataataatataacaccgaatctttttcgacgtttactttgatatttcttttcgcctcaccgccatccattttatggattttttcaaatgactgcgacagtacttccaagtctgccccctgtcgtacctgataggaaaattcctgcaaatcaccgctcataattccggcggatgcacaaagaggcatgacctgaatcccgccattttctttctcaaatggtgtcataatcttatacggggcggtaaaggatacatcctctaaaatggtttttccgtctttttttcctgcacagattgagacacgggatacttttccgaatttattttccattctacatgccctctaagaatacgtttttcttaatccactctaccacaatatccacattttcatccccacggatgttggtaaacacaaaaggacgctctcctctcatttttttagagtctctgtccattacctcaagacttgctccaacataaggtgctaaatcaattttgttgattaccagcaaatcagaacgggtaattcctggaccgccttttctcggaattttatcgccttctgccacatcaatgacaaaaatcgtcgcatcgaccagctccggactaaaggttgcagacaaattatctccaccactttcaataaataaaagttcaatatccggaaaacgctctaccatctcatccactgcctctaagttcatcgaagcatcttcacgaattgctgtatgtggacatccgcctgtttccacacccgtaattctctctacaggaagcacactgttcttcgccagaaactgtgcatcttctttggtataaatatcatttgtgataacagcaatgctatattcttttgccattttccttgataaggcttcaatcaatgctgtttttcctgaaccaaccggtcctgctactccaatttttacataagacatattgctttcctcactttttagctcacatttactttttacgacatatataatctggaatacagtttttcatgctgaattccacggatatcaaaccccggcgcagacagacaaagctcctctttggtctgtgtttttaatgtttcaagcacttcctgaaattcaaaaaagcatctgcttaacaacttttgccctacactttgacttaacggaatcgtctttacacagtttgtcaccattgcagaggtctgcgcataaagataatgttctaatgcttcttctaactcaattccaagcgccgaacaaaacactccataaacacagctgtgactgatattttttccttttcttgctgtcacatactctttataaattcctgtttcattaatttccaaatccagtttttcaatcgtctttacaaaccgagagcccatttttctgactgcatctctttgttccatcggaattctggatgcctctaaaatttcttctaattcttccagttcttcaagacgttctgcctctgctgactcataggccagctttaccgaaagcagttctgttgtagcaaaattccatttaattttatttttaatatactcttctgctgttttttcatcatgtacaattccattttgtatataagcttccaatccctgtgaatgagaatacgcaccaattggaaataaagcatcatttacctgaagcagataaaattttttctgtgacatgtaaacgtctccttttaatgatgatgattatgaatggaagcagaaatccgtttatcaaaatccaatttcatcacttctttttctgcttttacaccatgaattttttcaagcatcacaagcattggctcattataaatcgtaataaatgtatcattttcaccccaaaaaagcggtgcatgacggtttccaatttcgtaacataccttcgcagacatcttctcatgtcccggtatcaaagtcacacgaatcacttcacatggaggggtattgactaccactaattttttatcatctgcatagatgacatcgtcctgataaagaccgcgggaaagaatggaatcatccattcttatcccaacttctgtgcctttatctgtatttttcttatgaattcttttaaatgcttcatgccattcaatatcaactgtttcgatttcttttccggttgtatcaaactcattaagctttccaagtacctgttcgcacagcatattttttcctcactctctaccaaacctgtaacagcatcataacccctggaatccaggcagttaccacaccttcaaagacctgcaggcaaggtacaaattttccaagtttctttcccataatgtcctctacaaaagcagttccccacagaattgcccataagtaccagatagcagcccagcggatatctgcagtaattccaagtgcactgcttcctgtgataccctcgattgtaccaaatactacggcattgactgctacaaatgtagaaaaccaggcaaacggaatcggacttaattttaaaattttactaaatgctacaaataaataagtaaagcagaataacagtccagttcctgctgcataataatttcccataacgagattgacaaaattaataaataaagacaatccaccggtcaaaatattcatgaccgctgtagattttccatccactttatataaggcgcacattccgttattaattaatacaatccctacaaataaaagacaaactcccagcataagctccctcctgagtattattttatttatgtcaattgaacgtaaaacttgaatttagaacaagctgtacagctgtgtaagcggcagtctttcagctggttttgaagtaatttcctcgccgtctaccgtcactttataagtctcagggtctacggtaagttccggtgttctgtcattatataccatatcttttttaccgatggtacgacaaccttttaccggaacaactatcttttcaagaccgtatttttcttttacattttcatccattgctgcctgtgaaacaaaggttaagcatgcttcattttttgcttttccatgagcagcaaacattggctgatactgtaccggctgagtggtcggaatggatgcatttgcatctcccatcttagatgccacaatcataccgcctttgataatcatatccggttttgctccaaaaaatgccggattccaaagtacaaggtcagcaaactttccttcttcaacagaacctacatactgtgcgattccgtgtgtcagagccgggttaatagtatatttggagatataacgttttacacggaagttatcattttcatgaccttcatcttctggcaatgcgcctctttcatctttcattttgcttgcagtctgccaggtacgggtaatgacttcaccgacacgtcccattgcctgtgaatcagaactcatcatgctgaaaattcccatatcatgaagcacatcttctgctgcaatggtctccggacgaattctggaatctgcaaatgctacatcttccggaatctttttatccagatggtggcataccataagcatatccaaatgctcatctaacgtatttacagtataaggcatcgtcgggtttgttgaggatggcagtacgtttggtgctgctgccgcacggatgatatccggtgcatgtccaccgccggcgccttctgtatgataagtatgaatcgttcttccaccgattgctgcaagggtatcttcaacacatccgccctcatttaaggtatcggtatgaatggctacctgtacatcgtattcatctgcaacatttaagcagtgattgataaccgccggtgttgcaccccagtcctcatggatttttaatcccattgctcctgcttttacctgttcaatcaaaggcgcttcatcggagcagtttccttttccaagaaatccaagattcatcggatattcttcggctgcctttaacatcattcttaaattccatggtccgggagtacaagttgtcgcatttgttccatctgccggacctgttccaccaccaatcatggttgtgactccactgtaaagcgcacagtcaatctgctgaggactgatgaaatgaatatgggtatcaattccacctgctgtgacaatcatgccttcgcttgcaagtgcttctgtggatgcaccgactgtcattcccggtgtcacaccatccataatatccggatttccggcttttccgattcccttaattttgccatctttaattccgatatctgcctttacgattcctgtagaatccacgattaatgcatttgtaataaccaggtctaagtctccatctttactacaggtttttacagactgtcccataccatcacgaatggtttttccaccaccgaatttgacttcatccccataagtggtatagtctttttctacttcaattacaagactggtatctgccagacgaaccttgtctccgacagttggtccgtacattgctgcatatttacttccggaaatttttacactcatcttcgtacctccttacagaaatccttttaattttgctgtttccatcgatgtcgctttggtatcttcacctgtctgggcacgggttaaatcatttaacccaaagacacgttttcttccacccatctcggttaactgtacctctttttcttcacctggctcaaaacgaaccgaagtaccggatgcaatatccagatgatatccataagccttttctctgtcaaaagacagacatttatttacttcaaaaaaatgataatgagaacctacctgaaccggtctgtctcctttatttgcaacaagaatggttactgtttttttgccttcatttaatgtaatatccctttctgccggaataatttcaccaattttcatctgattgcctcctttactgaatcgggttatgtactgttacaagtttggttccatccggaaaggttgcttcgacctgaacttctccaatcatatctgctacaccttccattacgtcatcctttgtcagtatttttgtgccaagctgcatcagttctaccaccgtttttccatctctggcaagttctaaaagttctgaactgatgtaggcaagtgcctctacataattcaatttcagtcctctttcttttctctctttcgcaagatttcctgccatgtgaagcattaatttttcctgctcttttggattaagcctcataacatttcctcctcttaaaggttctaaaagtcagtttttaagtctgcaggtttttgaaatttcaatcgagcgtaaacaaaaaaagcagacaaacagcaccttacttcaagacgccattgtctgcttttaaaatcccttattcttttcaaaaactctacccgcattatacacgaactactttttttcgtcaatcattttcttctctaattcgataaagtttacaatttattcagattttgcgaaactcattttcactataccatactctgtccttttcattaatatccagcgcatacaatttttcatcttctatttcaattacgattgtatgctggttttcatcctctaaccacaccttatccattgccggttttccctccggacgcccctcacagccaaaatccggttcatcaatcctctttacgaaatattccattttttcttcctcttttcctgttttttgtattatttaaataaaaattatagcaggtgtttctggtaaaatccattctatgtttctgctaaaatccattccgagtcttgttttactctttcacttgtcttataatcgaaaccgaatctaatgaaaagaggaaatttttatggttaccctacttcttaccgaacagctcactgtgctatttctcatgatgggctgtggttttgttcttgtaaaaacaaaaattgtaaaatcaagagacagcaaaaccctgtcccttatcagtgtctatctgattatgccttgcgttattataaatgcattccagattgactattcaaaagaaattcaagatggatttttactggcactttttgccgctgttatccttcatcttctattgtttcttatctgcggaatccttggaaaatttttaaatttaacttccgtagaaaaagcatctttgatttattccaatgccggaaatctgattattccgcttgttacttccgttctcggaagcgaatgggtcatctattcaagtggatttatgtgtgttcagaccttgcttttgtggacacatgcacagtccattatgcagggaaaaacagaatttaactggaaaaagattttgcagaatgtaaacttaattgccattgtagtcggaatcattctcttctttttccacatcaaacttcctgttattctatccgacaccattaactcccttgcttctttaatcggaccggtcagcatgattatgcttggaatgttactcacagaagtagactggaaagcactgtttacttccagacggatctacttaatgacagcattaaaaatgcttgttctgccacttattatggtcggctgtatgcggattcttgcgcatcactgctccctcgcaaatgcatctacaatactgttaatcagcctgcttgcaacgatcactccgtctgcgacaaccattacacaaatggcacagatttatgataatcatccggattatgcaagtgcaattaatgtatttacaacagttgtctgcattatcacaatgccaatcatggtattattatatacactttaacgcaaacacccctgtattctgttttttcacaaaatacaggggtgttctatcttcataattcacttttaaaatggtcttggagagccacaatactcacagaatcttccggtattttccgcaccacactgacatctccaggtaccacctgactgctgcatattattcatgtctcgctgcatgccctggttcattccctgattcatgccttgattcatgccctgattcataccataattcatatcttgctgcattccttggttcattccccggttcatcccctgattcatgccataattcatgtcctgctgcatgccttgattcattccccgattcatgccctgattcataccataattcatgtcttgctgcatgccctggttcataccataattcacaccttgattcatgccataactcattccttgattcatgccttggttcataggcattccactctgcattctcggtgcctgtccggtcagcgccgctataatttcatttccgacacgttccatctccatcatctctgctcgattttcctgctcaattgcaaaactgtgtaactgaaaatccatatcatcaaaccatggagatctcacctgaatcttcatactgtaataatactcgtatttataaaccggtggctgataactgactgtctttccatctttcgtatatgtctcttcgatccgatcctgttttacatccatattacactgaaccacatctgacagtgacagaatatccggattttcttttgtatccaggttatgcgcaatggtaaaatttccctgcgtttcatcaagaaataccgtgtacttttttgttgtgatccgtcgtgtgatacggaaattctgtactttttccttatttgcttcacggtattctaattgttgtttaatatcctctacggtactatgtctgcgttcctcaaaccatggagacagcttcttcgcacattccttacatagatttccatcatctagtttgcgatttccaagcaatccgattttttctccacagatatcacaatatttcttatcgaataatcccatcttattcctcccgtctcttacatactttcagcatcctactcttcccctgcactttttacacatttgaaggtcagataatcatcttcatcactgtattgaacagacagtgacccatcctcttccattgtgataagtacattctccggtgcctcatcatccatttcgattgcataatatccataaagtgcagaccacggataagtgcctaactctgcgcctttataaatcacctgtactgtgcgatcttttgcgaaattcaaacgcattgcatcattaatattatctacaccgtccagtgtcgtctgtgcttcctcgtcaagcaactcttttacattttctgaataccattcaccaatcactgccaattcatcttctgacagataattttccggatttgttgcatctgtcccttctcttccgaagataatatttactccctgtcccagcagatcatcaagaataagggtatctccatcaagggtaactgacatttcctccccttcaatttttaaaacggttttttcatctttctttgccagttttccggtgcctttgtcattgtcaatcgtaaattttacttttccgctgtgctctatttcgagatttacatccccctcaaaacactcttcaattggcatctgcgttccaagcgcttctgctacaaccgcaatccatttcccctcatatggattctttttcgcagcttttccacctcctccacatccgattaaggataacgtacttacaaccagaatcacgctcagcaaatatcttatactcttcttcatctctttttcctcctttgcataatgtgattttctcttatattcacattatacaagggaaacactatttgttcactgttacttctgatagtaatttaaaaattatctgatttttattaaaaatatcattttaatgtcgtaacaatcaacttactttccaatgctgcggcaatcaaatcttctttgcagctataaccggcttttgaaatcatttcctgaaaattccaccttacgcctgcccttgaacaattcatcttttgagcaatctctgcataagaaaatccacaaatatacaatctcagcatctctagctgccttgggctaatttccccgctcgtaatccagtttaactccacactcggcgtaacatccggaaaaacatgttctccttttacagtgcgccaaatcacatcccgaatttcttcctctccatgatctttataccaaaggctgtccgcacacccacttttggcacgctccagcaccttcggatcaataagagaagtcacaatcaaaatctttgtatacggacatgcctctttgattgcttttcctgcttttaatccatcatgattatgaaaggtctggacatccatcaatacaatatcaatcgcggaataagtacaaattttcactgcttcctctgcatctgcaaccgtatcaacatgtcgaaattccggatcctgcaaaaggatatactcaaagtatcgttgcataatcttttgatcttctacaattagtacacgcaccataatttttcccctctttcaatcctgtctccactgcttactttgtctttggcatctttataagtaaacaaaactctggctcaaacacggtaaacatcctgcatccttctatctccaatgctctgcgaagcgcggataatcctccaccttctcttgcacctttttttggaaccattccatcgtttgtaagcttaagcagatattccctccaatcttcttctatcttcacatttactctttttccatgtgcatgcttcgcacaatttgtcacgcactcacgaattgcacggtcaagcaaaattcggtatgttgaattttccggaacatcgccttccagacaaatggtaatcccaagttctttggcatgcttttctgtatcctgatataagtcctctaaattttcaactgtcatacttgtaagaatatacacttgttgccttaacaaatccaattgtttattaatagaaagggtatcttctgtattttctttattttccagaattcttcgtattgtaagcaagctgcgcccaaaattatcatgcacctgcattttcattgccaatgtttcctgtttgcgtattctctcgccaatcttttcatacatttcttctaattgctgattcagcgtttccaatttttcattattaaacttaattctctcgctattataataaatttcggaaacatcaagcgcaattgcctgtctatatccagccagttccctgtccttaagctgatactcctgaaacatccagactttcccatccggaaaagcaaatacactgccatcagaactcatcgaaatgatctcttctctgaggttaccttccgaaatagcctgatgcagcatcttataattctgtaattttgttccaagcagcattttgcttacttctctcatcttggaattacaaagaataatctgatcaaatgcattcgcaaaacatacgccgcatggcgcattgtctactgcttcttttactgaccatggtgacaacctctgtttttctcgtcttatctccttgaaaatgctccgcaccagataaaaagtcaatcctgcaattccgcataacattaccacaatcggaacattcaaaagaagcgattgctccagcgcttttgcatcgtatttctgtacacattgcaataaaaccgttcccaaaaaagtaaccccaaaaagcacggttactgtaatttttcttcttaaatgagcagaaccggtcattcttaaaagtataagaataaactcaagcaccagacaaaattccataacactcattattaaattttgtatttctacactgcactctataaaattcgacatcgaatcagccactctttctcgtcttcttgttctacttctgcaccatgttgcccggaaagcaatgcataaatgtcattttctgaaataatatttaccgagataatcaaatgtgcctccatctcaacgacacgaaaaaagatcatttgcattcgatcaaacagttgctctaccagccactcaaaataatcataacatttaattaattcttcatcatggaattccagattttgaatattcacataataaagtgcccggatcttgcacaactttaatgccatacacgattctgccagactctgtatcaaatcctctgttttcagtgcttccctattttcattcttttcattatgaagcgttaacgtaagattttttcgcctttttaaataggttccgacaaccacaatcttccccagaagtcgttcatatacttctttcgactcggttttttccagttcttccataaagtgtgaaatcagttcaatctgaccggccgtctggctttgtatcaaatctaagagccgattttgttcttccacttttctccgctttgcctcctgctgatagttcttttgcaaaaggcgatttcgctctcttaattcttcttgctgttcttcaatatcctgatactggtccataagcaaggaaacatcctctgcccaaaataaatgaccacctcgcactaacaaatgattcattcgtgttccattttctatcacaagggtgccaactaaaagtgtttctcttacttcctgtggtatgtccaaaaactttcctgaatgataacatttcttaaagctccaatcagtaatctctgcatctaatccgcccgcagcttgaaacaactcaatatacctgctgttaattggaatcagtccacagataatagaactctgataaattgcggccatcaaaaaacaacatactgcggtcatatctcccacatatgctttaataaatggcatccccagaatatgacaaagattccagccaagcaataaaagtcccggaagcaccggaaaccaggtccactttcttccggaagcggcactcttacgcatcaacaccacttccattatcatcagacacagcatcatccaaatctgaatcaaaataaaaataaagcgatattcatagacctcattggaaaagaaaaatcctttcggaaaataaaacactttttgatgcaagtcatttgtcaatactgcaaaaatcaaacatagtgccggtattattaaacatgcactttggttttttgtattttctccttcttctttatccattaataatgccgcattaagcccgagtgtcggaatcaaaatcataggaatataataaagataccagcagatgcgcatctctaacggttccatgaaaataagaaacttaatcgttcttactaaaaaccaaaaaaccataagacaagcaatccacgtcaaacattgacgcattttcgcatccaccacatgtttctccaaatagatgacccaggcacaatataaaccgatataaatgctacttcgacactgaccggcaaactgaatcaaaaataagcttttaaatgagatctgccgacatatgtaagccaatataacaaggctcgcaattgcgatataggataacagcctttttttcttataagacatctaagacatcactcattcctttcttcatctgaaagcaatttcatatccaatcgtattatctttattgtatcatattcgttttccaaaatcgaatcccaactgtcgctgaacacaaagcgtaaatatgacacaactcaaaagcattaagtattgaaattttttttcatccatcatcccactcttctatactaaaagaataaaaaaaaagtaaacttttgtcactatcgtaagggctagtgtggacgctttgaagtcatgtgataatataattgaggtgattttatcatccgcaaaaaaattccaaaaaaattgaggtgatttttatgatttcttcctggtcagatgcaattggtctttccttcgcctggtcctttggatggggacttgtacttacctgctatgttctggattggaaaatcgaatggatgcagccaaaactttggtttctttttctaaaaaggaaactaaataagacagaagatttctttttgaatgcttctgcaattccaccaaaagtactaggcgcatttaagaaggttctctcgattttagaaaccggagactttcaaaattcatctgcaagtatcggacaatcttaccgaaaaaagctggagcatgaacttacattgttgaaaaaaaatgaaatcaagcatgaaattcgcatgactcatttaaaactgacagaggaaaatgaaaagaaacaagattttcgtcattggagcgacgctggacgtgaatggcgcgaaatcgtacttcagggcacggtattaaacagatatcgaagtctcaaaaacggaaaaattttatatgaagactttttcccacatggctctgtcctgcttagacagtccagacacattcgccatgacgaagtggggagcaaaaacagaaatgaagaacaacagttttatgctcagtatcaaaatattatttgtccaagctgtggtgccgagattacattaaaaggggacgaagcgcactgtccttattgcggtggttatatcaaaagtgatttctttgattggcagacagaagaatttttagtttatcgaagcctgaatccgaatgcatcctattataaattagttcttgcaaccatactcacttttttctttccgtctattccttgttttcggttcatccataacgattatctgatgtttggtactgcctttgcgcttacacttttactggctggcgcaatctggattttactcttaaaacaagaaaagaaagctcacgtttcgactgaccaaatcgtgcgttacgatgaaaaagttttaattgtagatctcaatgaagcactttatggtaccgagctaaccgccgatgccctgttttacagtgtcgataaactacagctgaaagacgtagaaaacacagagaatcgcacaacgattaccatttctgcagtgctgcacaaacttacacttcagccaaatcaaaagattctaaataaaaatgaaaaaataactttaaaattgtacagagcccgttatccacgacgcatgaaatcaaaaggacaagcagtgtttgaagaaaaagaatgtcctcgttgcggtgcaaatttcatgccggacaaaaatggctgctgttcctattgtggctatcagctatcaatagacaattcaaaatggcgaattgattacgagtagaatatcttatatttagtaagtggctgttgcactaattacttagtgcgacagccactttttctgagtttcacatataaaaaccagcctttctttattttcccatccgttccacttccactttctggttcaaaatgcctttcttccacaccatcacatacacttcaaactctacagaatcctgtgcatacacaaatggctcctgccacagcacttccgactcgattccttttgcttttaatgctttctgtctttcataagcctgttcgatttgttttttatgttctgcgtttgatttctttccaaacgaacgtttcggataattttctgcttctttttgaagctttttatctaagagtttgactaccgcaagatgtcttttttgatgtagcattttcgctataatctttgcaatcgtttttaccggatattgctcataaagtgccagcatctgtatcagcatcttatcctttacctgcattgcgagttctttcatcagacggatggcatcgagattcacttgccagggttcactttttggaacgacatattctggtttaacagaaggatacgagcaataatttaatggtggaaattctgccagcagggcaagctttcgttcttccttcgtacaacagtttttctgttctcccaggtaatccaccttgtctcttagaattgcaatccgatattctaactggcgcagatattcataaccttctacccagaaatgtccgatttttccatagtcataacattgaatttccagttttaatgactcaaaaaagatagtaaataccgaatcttcaccctgatttaccaccagaatgtactctttttcttttttttccaaaactgccttgattgtaccctcataatccggcagatattctcctgtaaatcttgcattttcaaataccagaaaactttccactgcatcgttcatcagataaaccagacgccagttattactgttgtcttttggtgctaaaaattcaagctgttctacctctacaagctgtgccagtttaaaaaattcctccggcatttcttctgataagccttgtaaaacctgtttgtaatataatttatcttcgttgtccattttttcctcattatcttttatggttttgatttatcgtatcataattggagaaatttaaaaagcccccgaatcttaaatccaaaagcttataaattcaaacgttttctataattagagcattatcgtttcactttaaatgcaacgtattttttttcgttgcatttttcgttgcaaattttgacatttttctgctaatcgttgcatttcaaatgtatcaaaaactctcagacttctgtccaagggttctaatttcttctgttttcttttatcttcttctgccttttcctgctgtttctattcttctgctgtttctgttattcttctctttgtttttgaactctcttatctacataagtctcttcgccactttccaggcaaattgcagcaagccttccacttggattgcacgctccacaatctattgcgatatgatttttctcccgataaatgtatcctggtctctcgttttctgcaattagctgggttggagtgtgtcctgttaccagataagtattttcaaaatactgccgtccataatctggtctttcccatacaatatcatgcagagaataatcttctatgtctttctccggtgaaaaatttccaagtccgccatgtaccagtaaataatttttcccttctattgtaagtgtttcatataccagaaaatcttccataaaatccagcacgtccagctgtgtttcctcatctaatctacgaaattcactgattgtcgtctctgctccgttatactgccaggttgccagattatccagaagtttttcgtctattttttcaatcgaactttctgtaatttcctgtcgaagaaatttcaggcatttcagtgccatcacctcatgatttccaacaaggcagactgcattaggcatttccatcaatttcagcaaagcctttatcggatgcggacctcggtctatcacatcacctaaaacatacaaagtatctgcacttgtaaatcgaattttttctaacagcttgataaataattcatattctccatgaatatccgaaataacataagtagccatgtacttctctcccctctgtccgtgctctttttctttattatacctcttgtctgtagaaccccacaagaaaaaatctcgcatagcatttatcttagtcggaaattaagactttcattcatgcaaatttattagtaagctcgtcaccagtcttatatcaccaaaataaaattctattgaaatggattgataactcgctacttatagaagcaggaatcttattgactaagataatgcaaaaatttaagcccccgaactttaagtccgagagcttataagatattttttaaactgcctctgcgattgtaatgcatgcataccgttcatcttcaatgatttttcgcatcatctcaaccggagtcattcctattccttcatccagatgctcaaaaattgtgacagcacttccagataaaagctgtactccttctctttttttatctgcatgaaaggcattgtgacgggaatctacattccagaaaacaacattcggaattgtataaccatttcttttaaatttctttttcatagtttcataaaacagccagtcagaatcataagttgcagagtcaaattccatatctgaaataataattaaagattttggcatttcttcttctggtacatgattttccaccgcagttttaagaatactatcaaaagccgcttccagatttgtattcaaaccccagtctgcctctactgcacaagcaactttttcagctaaagtttcaccttccaaatgcacaatgcttggtaaagcgctaaacgtcatgaaacgattatggtaatctcccttatttctttctgcaaaataaattgcaagaccaaccgaggttgccattggtcgtccatacatagagcctgaaacatctgccataacaagcatattttcatcaccaactccataatccggaagatttctccactgtgcttccaacaccttactatcctcgtttccgtataaaatcttttctactatatcataaggatacagtgttttagaatgaatgttttccttgccttccagtgccaggttgataaatttttcaaatctttccgtatcgtgtctgtcaaatgctcttcgatacttcatcatcgcacgtcccggaacggcagaataatcaatctcatcccaattgttgccacacatttttatttctgtaacatcaatatattttcttaacgtacggattattcttttaaagttataaactggatatcctaatttctctgcagttaaaatacctaattttcttgtttcttctacttttgaatcagcagttttcacccattttgcaagcagagacactggtttgcctaattgaaagttttttaaatcctccagtaactgtcttttcattgcagtccacattgcctcttctgccggtgtaccaatcagatagtaccagtcatcaaaacgaccatattcaccaatgaaatcaatgtttggaatcactgcctccggatgatattcagccagattctttaataaaatctgaaagactcttcgctctccaagaccctctcggatgtctcttgcataaaataaaattttaactgcagacaatggatcttcttcataagccttctcaaataaaattttgattcgttcttcatctgcagttctcagtgcaccgattgttgcaaacaaatccagattcgcattatctgttgtgttcactgctcttgcaccattttctgtatgagttaatttatttgatgttttctctaataattctacgaaattcattttgcttccccctataagttcaagccaaacgccaactcttatgagtgtttgattctacagagttacgatgagtgagggcaggactcgaacctgcacttcgtcctcttctcctggaataaattgctgtatgttccacaaacatgaaacactttttcgtgctttaccattaagctacctcactcagataaggcaggcaggattcgaacctgcatcaatttacttacattaaattagaaataagaaattaaaattgctgtatattccacaaacatgaaacgtgctttatctcatactctaccattgagctactgccttatatttactttatcttgttgacaagattagaataatccttatcttcagaaattggagtggattttttctttttttattattccctcatcaactgagcttatcttatcatactgtcggtacctccacaataaaccgccggtttaaaaataaaacaaatcgttaaagctcataaattattagaaccctcagacttctgtccaagggttctacaattcaaaaattcattttatttcttctcaattaatgccattcttttgtattttcatctgtaacttttaacgtatccttttgtattaagaaaaaatccacaatcgcaggagacgcagcttccgtattatcagaatcataataatattcctgcaatacatattcatccgtttcttcatctatatgcgattcattatacagcaaatgcagttctgttactgctccggtattttcatcaatctttttattaataacagcaaatggccagccttttgaagtcagacgaaactccaactgatacttcgtatctggataagaatccaagaatacatctgatttcgtttgaatataatccgatacctctgccaattcttttttgtatcgttgatattcttctgtcatcggatagccatcttcatcgtatttcgtattctcttcttctgtttgttcttctgctatctcatttaattcgtctaaagtttttccatatttcgtgttcagttcatttattttatattttccatcaaaaaaaagaagaaactgctcatcgttttgctcctctccatagataataatttcaacctggttctttttccacgtaacctgccaggtgtcctgcgaaatatttcccccatcatctcttagcgaaaatttaactttactgattcttttttccccttttttcaagataaactgaccatccgcaggaccgaaaaataatggctcccccactgcctgcatagtcaaagaatactctccatccgaagaaacacttgtgtctacattcgaaactttaaaaacaattagataataaaagattcctacaaagcacaataccgtaatacaaagtcctgccagaatcccaaacaaaccttttattattgtattatgtactttgatacagccgattaccaaactcactgacagcagaatccatatgaatagaattaccatcttattttctccagtgtctttatcaatatctcactactcttttcaactactgtacaattcattttttcaattgattcatcaattccaataattccatttcccagtcactgattctggaataccagatacatccataagcttcacgaattttaatatttaaagacgaacagataattactttcgtatctattcctctttcttttaaaattccaagcagtttttctccggcatcgaaatctccctcttcgccttttctcatcggataatgcatatctgtaataattaaatcaaagggatttcctgcttctttttcctggattaataattctaatccctcttccacattatcaacctgtgtaacatctgttacgccacatctatcatctaacgcttttttgatatcatttgctttatacacgtcatcttcaaaatttaaaattctcatttgcttattctccgttcaaaattctctgatatagttgttggactacccctttggcaagctgtttacaaatttccatttggttggtgcctgacacctttccttttattatacagctacagcttgaagccacgcaagaataaacaaaataattctccataaagcaaaacgaaagcctctaaagctaatattctgaaggctttcaatcaattttttaactgattcgaatttctcttttttcttgaatatcctttggcatttgtacaataattttcttagcaatcgcatcttcaagataatactcatttaatgtatcttttaaatatttttctcttttattccttgttgcgtctatcaacatatctgtaaaaaaacgttcccaacttacatatttctcacattctacatattttgatgtattttctaagatatcatctaaattttcgtattttataactcctgattttaatattaaatattcaaaagattccggaagccaaagagatattctgcggttaaactgcgtttcaaaataatcaacacaattttcaatcagtgcaccaaatgccgcgccatctgcaattactagtacatctttgttatccaacatttttactcttcactcgaaactcataattacccttcatctgccatttcctccgcttccaacaattcttctacatattcccgcggattatgcacaatttttcctgtattcataatttcaatttcaaagtttcctttaaaatgcataatatgcctcaagtatataactaaatctttctgttctgcaattttcaaaatccactttgcacagttatctccgcaatttgacgcattatatacaaaagaatcatctttcaacattaaaataagaacctttactcccccagataattcttttggcgtaatcgctcccaaaatagggctgtcaataatatgtgaactaattacagttgaactgtccacatctaaaatcatctctttgacaaaagaatcttcaatcctctcatcttcatatacattatcaaaatatgactgagcatctttcatatactcagtacccgaataataccatatttttagcatttttctctcccatttcatccttctacttcttagcataaaacggcagaaatatgattactagtatttctgccattttttatcacttcttcacactattcaatccatccacccaattactaaaagcttgaccacaacaaataaattgagcaaaactctcaactttccacctgaagtttctttttttcttacatgtttcttacagacaaatttcttcaattacacattcatgttttttactctttttatcgtagttaatccctgcaagaagtaaatttcctttatactcttttaatgtttccacataatgccgttcttttatctgttcaatcgctccttttgcatctttatcccattttagttcaataattactgctggtttttcgctatgaatttttcttggaataaagcaaatatcagcaaatccttttcccgatggaagttcccgaacaatcgtataatattctcttgcaaaataaaacgccagattaatggtacagctcaatgaattttcatcattatattttaaaatagagatttctcgatgtgccttatcaatcccttgtgcaacaaccacttcatcttttctccacagtgcctctaataattttttcgatgcatctacagaatcaatcacttctttccaatccattgtactgattgcattaatatattcctgagaaacctctttattcggaattgataccgttttttccatccaatgataactcagatatcccaagtgaactaacaaagtcaatacatcatcttttccctgaaatgttgtcatatcattagaaaatgttccaatattaatcggaacagcttctcctgccagcatttttacaatatcatcttttaatccttcaaaattcatgcgaatataaatttttaaggcttcataagtctccgtctgattccagtaattatcaaaaattccacttaacattgcatcaactacagattttggactgtacattgcataagtaacaagctgattttccttcatcacagttaattcatacccatcataccaagcctgtgtttcttcaaaacttctgccatattttttacagagacttctcacttcttcctctgtaaatccaaaaaattctgccatctctcgtggatttgtcatcgagtattctgaaaacatattcaatgcagaatgagaaccatactttttaattggcaaaattcctgtcatataagcaagtgccacatattccttatccttcagccacgctcgtaaaaaatccagatatcgtttctgcgcttctttgtcattttgatactctcggaataagcaatcccactcatcaatcaaaatcacaaaagaatgtttcgtactcgcataaatatctttcattacctgaattaaatttttctcatctctaagccgaacttgtccaaatgcttcctgtaaatcaaatatcaaatatctgcgcaacatatctaacatttcttctacacttgtcgtttcacttagaaattcctgcatattaatcttaatcacatcgtatttatttttatgtttctgataagattcacattctgctatctttaaattctgaaataattctgttgactcctcttctcgctcataataagcagtaagcatatccgcagccattgattttccgaatcttctcggacggcttacacaaacaaatctctgcattgttcccacacaacggttcgttacttctattaaattacttttatccacaaaaatctgagaatttaatgcaatttgaaataatccatttcctggattcaaataagttcccatacgccgtgcctcctaaatttttaatgtactcttattatactgcctttgatttaagccacgcaagaataaacaaaagaattctccataaaacaaaagcctccaaagctggcactctgaaggctttcgttttgttttatggaatctcatcacattccttagctgttattcgtattgttttttactttcatttaatttttcagctgaatttgattgacatctggttccttttattgaaaattataatctatttttcttcttttcgtttactattggtatgaattcctctattctcatctcctgcttcattaactccaaattcgtagtcatttcccggcagaataatatttaaggcaattcctgcaatcgctgcaatcgcaagtgctgtcaaagtaatcgaagttcctgctaccgtaaaggtaattccaccactgaatcccagaccgcagacaaagataacgcctgcaataatcaggtttctggattttgttaagtctactttattttctacgacattacgcacaccaattgcggaaatcattccgtaaagcatgaagctgactccaccaataattgcgcttggcatggtactgataacagcggatacttttggaataaagctgacgataattgcaaacacggcagcaatacggataactctcgggtcatagactttacttaattcgagtactcctgtattttctccataagtggtatttgccggacctccaaacaaaccggaaacagctgtcgcaagaccatctccaagcagagttctgtgaagtcccggttctgcaaggaaattttctcctaccgttgcggaaatcgcagacatatctcctacatgttccatcatagttgcaatggcaatcggtgccataacaagaaccgcagttacatcaaatttacaaagctgaaatcccggaagtcccacccagcttgaacttgcaatagatgcaaaatttaaaattgcagaaccatctggattcttaattccacacgcattcataatcattgccactgcataggaaatcacaacccccatcagaatcggaatgattttaaacattccttttccccagatattaaacacaatgataactgcaagagcaaccagtgcaagaaaccagtttgtggatgcattggaaattgcagagcctgcaagacttaaaccgatacagatgataaccggtccggttacaacaggcggaagataacgcatcacacgtttgactcccacgatacggataatcagtgcaaatatcagatagaaaagacctgctactacaactcccccgcaggcataagctgctttttcatttgctcccatagatgcatacattccactgtttaagtttgccactgtggaaaatcctcccaaaaatgcgaaggatgaacccaaaaatgcaggcactttgaatttggaacacacatggaacaacaatgtaccaaatcctgcaccaaataaggttacggaaacagtcagaccggttgtaagcggttccccacacgcctgaacaaaatagctgttgaccagaatcggtactaaaattgttgcaccaaacatggcgaacatgtgctgtaagcctaaaatcagcattttaggcacgccaagttttctggcgtcacgaattgcttctcctctttctcccattttttctctcctctttcgtttttttatctttcatgtgctctcggaatttttttgagagtacatcttccccattatagaggagagagtcctgttatggcaagcaaaatcagagaatcctttcaaaaatcatacaagtttataatgcaaaaaactctttaatctgtcccacaataatctgcatcagtctggttctcgcttccacacttgcccatgcaatatgcggagtaatgataagcttcctgctgtcttttatttttaccaatggattcgtttcactcatcggttcttcacataacacatcaagacctgctgccgcaatttccccggtctccagagcttcacacaaatcctgttctaccacaatcggtccacgtcctaaatttaagaaaatcgctgtctttttcatttttgcaaatgcttctttattcatcaaatcttttgtatattcatttaacggagcatgaacagaaacaatatcggatttggaaagcagagtatcaaaatctacctgttcatatccttcctgtgcgcttcttccggaagccgaataataaaccacatgtgcaccaaatgctttcgcaatatcagcaacccgtcttccgatcgttccaagcccgataattccccaggtttttccgctgatttcattaaaatgctctgcaaaatgcgtaaaaatcgtatcattgacatatttttccgttttgacatactcatcataataacgcaatttttctaataaatagaataacagcgcaaaagtatgctgagtaacagactctgtcgaatatccggctacatttctccatgcaattccacgtttttcaagatattccttatccagattgtttgttccggtagctgttacgcagactaactttaaattttttgctgttccaatcgtctgctcattaatctcaatcttattaattactaacacatctgcatcttttacacgctccggcacttcctctgatgtggaaaatccatatttcaccacttctccaagcgcatcataggctgataaatcaatgtcatctcctattgtctttgcatccagaaatacaattttcatgatccatctctcccttaattaaatttctttactcatttcatcataagtgcaaaagttatatcctaatctctgatatagcgcaaccgcacctgcattttctttttctacttccagacggaatcgtactgcatctgtatagatttcttctactgcctcaaaaaattttcttccgattccgtgtcctctatactccggtttcatatacaaatcttccaaccagatacacactccgccaaattcggttgaatatccggtcgctgcaattccatatccggcaatttcaccttcgatttcaaacacatatccatccacgtatgggcagtctccaacgcaatctgaaatatctttctgtaatgtttcgtcatccgctttatgaatgaccacatccgatgcataaaagatctgcatcatttctaaaacctctgctctgtctttctcctgcatggaacgaattataacctctccctttttcatttctaccttcattgttagtatcctttccttatgaaatcatgttctcctatcaccggaagctttttcacatccatatttgtaatcaaaatatacgtctgtgaattcaaatactgaatgagttggtcaatttgctcttctaaaccttgcacttcggcttcgaccgtcccatcgtatttgttttttacccagccggttaatccaagctgccttgctttatgtacgcaataatatcgaaatcccacgccttgtacatgcccataaaaaataatatgtctgcgaatcatccatacactcctacatctttaaaatagtaaaaacatttttggtataaatactatatccgttacgttcagaattttctccctcaagtgtttcgttgctactatcatagggtgagtaagagacttttgtcaagtctaagaacgtaagtcaaaaaaagctcccaataagctgaaatttcatgcctgttgagaacttttttctaaaaatattttaagattattttaaaatttcaatatctgtctgtattacctgtggttctttttttaataaatattctccatttcgtacagaagccagaattccggctcgttcgcatactgcatcaaactctgatttcgcttcaagtacaataaagtttgccggtttgccctcttctaaaccatattcgtcctgaatatgcatggtttttgctccatttacagtaattaaatccagtgcattgtcgatttcttcaaatgacatcatctggcaaatatgaattccgtgatccagaatcatcatcatgtttccatttccaagaggataccatgggtctgacatcgaatcctgggcaaagcagacattaatctttgcatcattcaattcttttactctggttaaccctcttcgttttggataggtgtcctgacgtccctgaagataaatattttctgtcggacaggagataaaattaatttctgctttcttcaataatttcatcaaacgaaaggcatagctgttatttgcagaaccaaaagaacaggtatggctggctgttgttttacttccgattccttccattgctacaaccagctcggtctttatcagctgttttccgatttaaaccagactcctttatacgaatctttcatggaaaatcaactgggtgtactcatccgctatgacgcagataaccacacccagttagttgaaacgttatctctttatttacaaaataattgtaatattctgcataccgcagatgctgcctatacccatagaaataccattaaataccgcattacaagaattgaagaactgttacgtgttgatttacaggatgcttctgttcgtctgaacctgcatcttgccctttatctgcatcagttcatcttaactacatgatttacgcatgccagatatcgttattatattctgcaattgtacggtcagatgaaaaatatcctgcctttgcgatatttacaatcatcttctttgcccatgcttttctatcttcataagcttttaaggcttcttctttctttttagtataagccttgaaatccaagagtgtcataaaccagtctttatttaacagttcattctgaagtctggttaagttttcttcatgaccgattgcaagcagttctttagaagtaataaagtctaccgcttctttgattgtctcatctttttcgtagaagtctctggaaacgtagtctgcattttcatagtgtttgattacttcttcgctggaagctccaaatacaaagatattatcatcacctaccagttcatggatttctacgtttgcgccatcttctgtaccgagagtcagcgcaccatttaacatgaacttcatgtttcctgttccacttgcctctttagaagccagagaaatctgttctgaaatatcacatgccggaatcagtttttctgcttttgtgacattgtagttttcaatcataacaacctttaagtatggactcacttcagggtcattgttgattaattcctgtaaacataaaatcaagtgaatgatatcttttgcaatcacataagccggtgctgcctttgctccaaaaataactgtgattggagtagatggtttcttacccgccttgatttctttatatttatgaatcacatataatgcgttcatctgctgacgtttgtactcatgcagacgtttaatctgaatatcaaaaatagattccggattcaattctacattttgagtctgttttaagtaatcgcaaagtgcttttttgttatctgcttttatatttaataatttttcaatggctgcatcgtcgtctttataagccaggagtttttccagttcctctgcattttctctgtatccggttccgattaattcatcaagcagagcggtcaattccggattgcagtgaatcagccatctgcggaatgtaattccatttgtcttattattgaatttttccggataaatcttataaaatgcatttagctctgtatcttttaagatttctgtatgcagagacgctacaccatttacactgaaaccgtaatgaatatcaatgtgtgccatgtgtaccacatcatttttatcaatgattacaacactttcatcatcaaattttcttcttactttatcatctaaaatttcgataatcggaaccaactgaggaacaactttctttaaatattccatcggccatttttcaagtgcttctgcaagaatggtatggtttgtgtaagcacaggttttggttacaatctcaattgcttcatccatctggattccacgtgcaaccaacaaacgaattaattccggaatgaccatagtcggatgagtatcattaatctggataaccgcatattcatacagatcatgcagatttgaaccacgtgccacacattcatccaggattaactgtgcaccattacttaccatgaaatactgctgataaatacgcagcagacgacctgcatcatcactgtcatccgggtataagaacagtgtaaggttcttttcgatttcttctttatcaaaatcaattccttcttttacaatgctgtcatctacagattctaagtcaaataagtgaagtttattgctctgattgttgtatccggttacttcaatatcatacattctggaatttacagtcagatttccaaaagttacaggataactcacctctgtttttgtcagccagctctctttttcaatccatgggtttggaactgcattttgtaattcatctttaaattcctgtttgaataatccaagatgatagtttaatccaactccatctccgcttaatcctaatgttgcaatagaatcaaggaagcaggcagccagacgtcccagtccgccatttccaagagatggttccggttcaatttcttcgatttcgcaaatatcttttccattttctgcaagcatttttttcacatcatcataaataccaaggttaatcatgttgttggataataatttaccaattaaaaattctgctgaaatataatagatttttttcttctttaccggtacttctttgtccttcgccatgttctgaacaacatgtaacaatgcataatacacttctgcattagatgcttctttgattgtttttccaagttttgtttctaataattcctgaattttcatcataaaaaaatcctccatcattctctttctttatcttgctctaaattctattttcctgttatcctgtcgtgtttcttatctgcattttactatgctttttcaattatttcttgcaaaatactctctatttataatacaatactatcaaaatataatttacaaattttgtataaaaatggaggaatttgttcatgaacctcacagaataccaaaattaccatgagtcaaaatctcatacttctctcgaatttccttataatacttacctttgctgtatccctatggactttacgcatgttcccattcactggcacaatgaaatggaattaattgtcatccagaaaggcagtggaatcatctccgtagactttattacccatgaagtaaaagccggagatattgtctttgtgcttcccggacaactccattccatcaggcaaaaaaaagaagcacggatggaatatgagaacattctctttcatccatctatgcttctttgtggtgaaccggatttgtgcggaacaaatttcattcttcctcttatggaaaatcctgctaccattcagacctttctcactccagatgcccctgcttatgaatctctttccggatgcatccgaaaaatcgataatctctgcgattccagaccaaaaggctatcagcttgcagtcaaaggctggctcttccagcttatgttttatcttgtgtccaatcagcagacactaaaacagccttctcagtctcaccaaaaacatatggataaactaaaaaccattttaaaatatgtcgaagaacattacaacgagcctttaaacattgaagatatggcaaatctcattcattacagcaaatctcatttcatgaaattttttaaaacacatatgaatatgggattcacccagtatctcaatcattatcgaatgagcatggcggcaaaacttttagtttcgaccgatgattctgttttgacgattgcagtctcttccggctttgataatctttcgtattttaatcgactctttaaaagagaatttcatatgacgccacgagaataccgtcgtcagcaatgatacgtttgacacttacatgattcttttcaaaaaaaccttattgagcttccgtttttttaactcaataaggtttttgttctatcttgattctatttttattctatttttactttatttgcttttcactgctcctgcaattttctctacaactacacaaagcacaactgtaatcaccatatccggtaatgtatttcccaccggtgtatctacctgcatcagcagacgataaatcacaaaaccaacaagccaaacagccagatttctccactgaaatgcagatttttgggcatctgccttttttaacataaagtaatctgcaatttgcactgcaatcatcggtgcaaacacagaaccaatcagatataagaaatttgtaatgttatccattggatacacaattgcggcaatcgttccaattaccgtaacgacaattgccgcccatttttcctggattttagaggaaatcgatacactcgaaactcctgcggaataagcatccaaaaaggtagttgtaactgtagaaaatacaataattaaaagtcccacaataccaaaacctgtttttaacataatctgcgcaatgtcatattcaccggtaaaaatagctgctcccataccaatcatatacataaaaatgctgaccagactgtaaacaactacacttgcaaatgtcgctgcaaatggtttttctgcttctcttgtatagtcactgatcagtggcagccaggaaagcggcattgctaccgcaagctctactgcggctccaaatgtcagacttccatcatctacaattgccggcatgcttccatttccaaaaaagataactttaaaaagtaccaacgataagataaaaagtgcagtcattgcaacggtgtttaatttaccaagatttgtaatcccaatcagaatccatacaataatcagaacaccgataataatcgcccaaatccaaatgccggtatgtagcacaccatctgctgcaagtgcaccgtcataaatcataattgcagtccaacccacaagctgtaagacatttaagatggcaaataaaaggcttcccctttcaccaaaactcatttttactgtttccatggcacttttacgttcttttgcaccaatcattcccgctgcaaacatcataagtccgccaatcagatgtcccagtaaaatcgctgccattgcttttccaaagccaagtggtgcaaaataagtaccggtcaggatttcagctaaagatacccctgcaccaaaccaaatcagtccgtttgaaaaaacggaagttctcttttcactcatccctcgtactctcctttgactgcaaatgcatggttcatcggtccgcttccttttccaaggtcaagcatagcggcaagcgcgccggaaatataattttttgcatattttacggaagtttccaaatctcttccttttgcaagatttgacgcaatcgctgaagaaagagtgcagccggttccgtgtgtattggaattatcaattctctttccatggaaccataccggcgcttttcctttttgaaaaagcaggtcgttcgcatcatttaactgatgtccgccttttaataaaactgcacagtcgaatttctcacaaataagctctgctgctttttccatatctgcttctgatttaatttccatctcagaaagaacttctgcttccggaatatttggagtaatcactgttgcaagcggtaatagtttacttttcaatacactgatagcatcttcactaatcagtcttgccccactggttgccaccataacagggtctactacgatattttttgcgtgatactcagtcagtttttctgcaatggtttcaatcagctcacttgaagaaaccattcctgtcttaatcgcatccggataaatatctgtaaaaatactatcaagctgctctgccaaaaattttggtgttacctccataatatctgttacgccagttgtattctgagcagtcaacgccgtaatcgcactcatcgcatacacgcgatttgcggtcattgtcttaatatctgcctgaatgccggcgcctccactggaatcacttccagcaattgttaatgctgtgtacatcattttttcctccttgttctttgcattaattttatagagcgacaaaaggtggtgcccccaatctgccgctgttatgctttgaatctttcaacgtattttaaaaatgcaggaacccaacgaaagattcctgcatctaaaacacatatctgtgattcattatctccctacgttggcattacccaaatcaggttccgggttaaagcatccgcttactctcagcctgcttacgcaagcaccccgctttttataacaattttattatacacccttatcttgaaaatacaagtttttgatgctatttttaccttgaacccaaatagcaggtgcaactgatatgataatctgtcgcacctgccatcttccttcatcgttcttacgatcgaggtaaagccttttccactccaataatttgttatatgcttttcttcaagatttcaatctcgcattttatgactttcttcaagattttattttacgtttttatgactttcttcaaaattttatttttctaccggctcatccatcttgcccaggctgccagccctgctccatgttttatttcacctgatgccaccattcttttaaattcttctatcgagacttcatgaagtttcagcacctctgccgggttcaaaaattcctccccctgttttccacaacaaattgcaaaaagatggattttctcattcgtcgaaccaaacgacggataaaaatctccaagcagaatcacctcttctgcttcatatcccgtttcttctttcaattcacgtactgctgcctgctctgctgtttcccccgggtctatcagtcctcccggaagctccgtctgccacaagcggattggataacgatattccttcagcgtaataatattttctccatgaaacggaagaatacttactccttcaatcatttcaagataatcataaggtcagatctgatttttcacccgtactttatcctgtacaagtgtaaagcgacccagctttattttctctgactctactgtttcaaatggactttttatttccttcatatttcttccccatttgtcttaatgacatgtttataccaatacgccgaatcctttagaattctctgctgattacgataatccacatacacaagtccaaatcggtcagaataaccttttgcccattcaaagttatccatcaatgaccactggaaatatcctctgatatccacctctgttgcagctctttttagttcatgcagatatcttccaagaaaatcaattcgattcggatcatgcacttttccatccagtgaaatcacgtcatggcaagataaaccattttctgtgatataaattggtttttgatatctttcatataaaaattttggtccccaatataaacattccggagtaaccggccactgtatcgctgttttcggaaaaccttcatatctttgaacggcctccggctttccattctctcccatacgataagcgcagccattatagatattttgtccatagacatcaattggttcagaaattaatttcatgtctgcatctgtaattttcggaagatatttttcataacgaaccaagccttcttccggataatgtccaagcagtaccgggtcagaccaccacgctacattccaggtccagttactgtcatcttcctgcatggaaaagtacatctgtcttgcggcttcaatatcttccggacggttagtctcaggatagcagacagaagaagtcggagcatatccaatcgtcagcttttgttttccataagcgcgaagcatctgcactgcacgcccatgtgcttttaatgcattatgtgccatctcaaacgtatctcttaacggtgcttttacacccggcgcatgctctcctgtaagaaagccaagtcctacgaaacactgtggttcatttaaggtaaagaaatgtgttactcgatcagtaaaacgctctgcgacaagctttgcatattctccaaaccactccacaatttgcggattcatccaacctcctcttttataaatctcataaggaagttcccaatgatacagcgtaatataaggttctatctcattttccagcaactcatcaatcagtgcattataaaatgcgattgctttttcattcactctgccatatccttccggaagtacacgtgaccaatcaattgaaaagcgatacgcttttaaaccgattgctttcattagctgtacatcttctttgtatctgtgataatggtcacatgcaacctctcctgtatgtccggagtagatctttcctggttcttttgtatatacatcccagatgtgttccccttttccatcttctgtcacggcaccttcaatctggtaagcacttgttgcagcgccccagacaaagttttctggaaatttaacttctgtttttgccattattttcactcctgttcttgttttaatcttaaagcaaacttgcagctccaatcattccggcatcatttccaagtgctgcgcagtctgcaacatgtggacaactgcttttatcttttataatcggaacacggttggttacagcaagtgctttttcaatgtgtaaatctcgtttttttccatcttttcccactctgccgtaatcatacacacgataagtcacattcgaattttgctgaatttcagcaatcaaaatgcctgcgccaatcgcatgaatggttccggattcaataaaaagcacatctcctttttgtaccggaactgcatttaatacttcaagtaatgtgtcttcttcgattcgttttgcaaactcctctttactgatttctgttttaaaaccataatacaaataggcacccggatccgcatccatgacataccacatttctgtttttccgtactggccttcatttttcaacgcataacgattacttggatgcacctgtacggaaagactttgttttgcatcaataaattttgtcaagattgggaaatcacgaaatcttcgacagttgagtccaagcacttctttgcctttgatgtcgatatattcctgcagtgttttccctgcatacattccatttgcaatataagatggcccgtccgaatgacaggaaagctcccaggcttctgcaagtacctttccatcatattttacaccatactcttctgccagtctatgaccgccccacagataatctttacagcttggtttcaattttaaaatactcatcttttatccgcctctatcatttctcacttaaaaaatcaatatatttctgacacatttctttatgggttccggtcgccggaaaaacaagcacaaggtcttctttctctgttccatcaagctcactttccagttttgtaccagttaaatcaattgcttttgttccttcagcttcacagagattcaagtcttttatctcaaattcatcggcagagtaatactctccgccaacactggtgcagtatttcagaaagtcttttgtcagaatcactgcatctaattctcccttagaccactggaagaaaaatttatcaaatccgctttcatttcctgcatcctgtttttcttcagcttccttataagaaatcacatagtctgaatcaaatacgattctttttgcatcaagacctgaaaatgtggcaaattcttctgataaaactacatccctgtctgaatcaattttctgattcaccaaggcacatttaaaaaacggtttttcttctggaaatgcaaaatggacaaccaggaaaatcaagagagcaaggactgcaagaatgcctaacatatggtaccaaataacattttgttaacacttaattaatttaatcccgattttttagtagtatttgccatattcttgcatattttaacttaatttaagattaataattgaattaaattatttttttttagtaaaaaagaccagtgagtgcatattctcaccagtcttttaagttctttaattaatttactatttaagttttacacttttcttaatcaccatgtggccagatacaatgtccattccatgtccacgttttggatttttaatctgtttcagcactttttctaatgctacttttgtcattgcttttgtatttacttcataagttgtaatctctctatccgcaagtcctggatagagataattatcgaatccaacaacagaaatatcttccggaactttatatcctctttcattcagcttatcaatcagcatatacgctgcaaggtcacagctacagacaaagcctttcggcagtctctttggaagtttaaatcccatctgtcccagttcacccctgtcctcaatgagccactgtggttttatctcttttttgtggctcatcattgcttttaagaatccgcagtatcgatccataatactgcttgttgaataaatcgagccaacaaagccaagttcttcaatttcctgttcaaacatgaattctgtcaacagatatgttccataaaaattatcggtaacgactgcatcctttgcaaagtctttatcataataatccagaaataccaccggaatccttgctgtttctgtcagctttacaatgtattctttattaatttttccaagaacaatcagtccgtccactttatttccttccacacatgccggaagttttaaagtatttctttcatcttcttttcttaaaatttcaactgctgcaaaacagcgtttttctgttgcagctaccgcaagttcctgatacattttccaataaaatgtttcgtactgtgcaagataattttctgcaataagcacaccaactgtataacttgcttctcctgctgcctctcttgctttctgttttcgttctgacaaaatctgatagcccatctcacttgccacactttgaatcttttcacgcagttcttcactgacacctttatttccggcaagcgcattatgaaccgtaaccgtgctgacacccacttttttcgcaatgtctgccagcctgacttttcccatctttttcacctcatctattcttttaatctttttcatctacttaaatttaagttaattataaagggattgggcttaagctgtcaatggacaaaaaaagaagacgagcctcgatgatttcgaccacctgtactcgtcttttttatattcttatatttttatatttttaaattactccatacttacccgctcaatatgcatcgcaagatatccaatctcaatctcttcaagttgaacccgaagtgccttactcaaatggtcacagacaattcttgcaagttcataagactgtggaaaattgtgctccacataatcattcatatttactttcagtgactctttatttaatgcccgtgctaccatgaattttatatggttcatcaaacggttataactcaaagacattacatcaatatgaatctttctctgtgcttcaatcagcgaaatgcattctcttaccgctcttgccatctgcatagaaaccgcaacggactctttttcaagcgctgaatgaatatgcagtgcgacatatccaatctcatcatcctgcacatcaattcctttttctttttttaagcgttcttttagtgccagcgcaactttaaattctccataaaataacgtcttaatatcctgggttaaaggatttgaaatctgttctcccttttgcattcgttttactgcaaactcgatgtggtctgccatcggaaacaaaatactctgatcaattgttccaaactgttctcttgccagattcaatatctgatttgccatttccagatattcaggctctatgcttcttgccagttcagaggctgctcctcttgatgaagtttcctgcaacgaataaacggtacactcttctggttgttccattcgttcgcctactttttttccgaacccgactccttttccgagcaacacatattctttattatccttcatatcaagcgcaatcaccccattatgatttaaaactttgcaaatacgatacaccgttctcccaccttttcccaggattcccccgtttttttctaaagcctttttgaccccaactttctatctctactttagcatatttcctgtcattttcccactgaaatttcagttttttgagaactcacaaattctttttctcagtttcaaaatcatacccggagcaacagagagttcatccactcccatcttcataaattcatcggtaagttccaaatctgcacctaactctccacagattccagcccattttccatatttatgagcgttttccactaccattcgaatcatcataaggattgccttatgatgcgcattatagaaatcatccagtttctcgttctgacggtcaatcgccagcgtatactgagtcaaatcattcgtaccaatactgaagaagtctaccatctgtgccaggtcttcactaatcataacagccgccggggtttcaatcattactccctgttccggtactttatacggaatttctgcggcatccagttcctgttttacttcttccacaatcgcaaaaatctgctctacttcttctgtagaagtaatcattggatacataacagacagattgccataaactgccgcacgcagcagtgcacgaagctgggtcttgaaaatctccggctgttttaaacagatacggatcgcacgatatccaagtgccggattttcttcttttccaagattaaaataatctacctgtttatctgccccaatatcaagggtacggataatgaccttttttcctgccatcagctgcaatgcctgcttataggcattaaactgttcttcttctgttggaaaatctgtttttccaagatataagaactcgcttctgaataaaccgattccttcggcgtcattttccagtacaccggcaatgtcgcctacactgcctatatttgcataaagatgcactttcttgccgtctgctgttacggtttcttttccttttaattcctgcagcagttttaatttttctgcttcttcacgcatttttgcttctgtttgttgttttacttcttctccgggttcaacaacaaactttccttcaaatccatctacaacggcttccattccggttctcaactcttctaaatcaaccggaacaccaatcaatgccggaatattcatcattcttgcaagaattgccgtatgggaattcgtagaaccatgaacggtcacaaatccaagaattttttctttatccatctgcacagtctcacttggagaaaggtcatctgcaacaatgatggatggctccatttcacttaaatcaacagaaacatctcctcttaagttttgaaccagacgatttgaaatatcttttacatctgctgatcttgcctgcatgtattcatcatccatacttgcaaaaatctcagcaaaattatcaccggtcactgcaaccgcatactctgcgtttaccagttctgtctgaatcatattctgaattgcatcctgataatcttcgtcttccaacatcatctgatgcacttcaaaaattgctgcgcttgcttctccgacttcttttaccgctttatcatataaatgctgtaactgtgcctgtgaatctgcaactgcctgttttacccgttctatttcctgcttagcatcctcgattttttcacgttttacctgaacatcattcttttttaataccgcaatcggtccgattgtcagacctctatacacggactttcctctatattcacgttccattttcatttcctctcttaaaaacggtcagataaaaatctgaccgccattttttataaattttcttcgaaaaatgctttcattccttcaaatgctgcctcttcgtcagcaccatcaatttctactcgaacatcctgtccgcattttacacaaagtcccataactgccatcagtcttgtcacatccactgttttttcccctttgctgattgtaatggaactttcatatttttttgcctcttttgcaagaatacttgccggtcttgcgtgaattccctgttcatctttaattgtgtaagtaaattctttcatgataatttctccttttattttttattttcttatttttttatgcttcataaatatcaattgcatataacggtgctcccgctttgatttctccgcttgcaagcagtctgactttctgattatcctctaactctgtacacagaatcggagaacataaagaaggtgcattggctttaagatactccagatcaagttccagcaatttatcacctttcttcactttctgtccgttttctacaaagcaggtaaatccttttccatccagttttacggtatcaattccgatatgcagtaacatggaaagtccgctgtcactcataaatccaattgcatgctttgtatcaaaaacaaaagcaatttccccatcttccggagcaacaactacaggatttgtaggtgttaccaccgctccgtctcccatcatttttcctgcgaatgcatcatccggcgcatttgccagatcatctgcaattccggtaatcgggctggaaacgataatcgtttcttttacttttccagtctgtttttcttctgttttctcttctgtttttgaatcggctgtttcttccattgtatgaagttcttcatccggagctgtttccagataatcttcaaagtttgatttaattacagtaacttttggtccgtagataatctgcacaccatttcctttatgcaccacaccggatgctcccgttgcttttaaaattgtatcatttaccagctctgatttatgcacggtacaacgaagtctggttgcacaacaatctacgtctgaaatatttttcttaccaccaagacctcttaagattccttcagaaacctggtcctctgcagatgcacttttttctccttcttttctggcattaacatctgctcttgtgtaaagttttacttcttctacatcatctctacccggagtttttaaatctaattttttaatcaggaaactaaacagcacatagtaaacaataaagtataccactccgacaactacaatccaaatccaatttgtctttttatttccctgtaaaataccaaataagaataaatcaataaatccaccggagaatgtcattcctactccgacttttaagatatgcatcagcatataagcaagtccggcaaatacacagtgaactccgtataataatggtgctacgaacaagaatgtaaattcaagtggctctgtaatacctgtcagcatagaagttaaggctgcagataaaagcagaccttctaccgcttttctttttttcggttttgcagtacgatacatggcaaatgcagctcccggaagaccaaaaatcataagtgggaacttacctgacataaatcttgtagcagataccgcaaaatgttctacactcggatcagataactgtgcaaagaagatattctgagcaccttctatcatctgtccgcctacttctaaggtaccaccaactgctgtctgccagaatggaagataaaatacgtgatgaagaccaaacggaattaagagacgttccataaatccatagacccaggtaccggcataaccggaacgaagtactaaatctccaactgcataaattccggcctgaatggtcggccatacgaaaaacattgcaataccaaccactacatagacaagccctgaaataatcggtacaaatctggttcctccaaagaaggataatacctgaggcagctcaattttataaaagcgattgtgaagcgctgcaacaccaagtccgacaacaatacctccaaatacacccatctgtaaggaagtgattccacatacatctgtagttgcaccggaaagcatagcttctgctccgccgttaatatcaattaatgctccaatagatgcatgcatgatgaaaaatgcgattaccgctgaaagtgcggcaacttctttttctttctttgccattccgattgcaactcccattgcaaatataatcggaagattcgtaaaaataatatttcctgcggcattcataatctgtaaaacctgattgattatggtgccaggtcccattacatttaataagccatatgcttttaacatggtctcatttgtaaaagaaccaccaagtcccagtaacagaccggctaccggaaggattgcgattggaagcataaaagaacgtccaactctctgcaaaattccaaaaatcttgtctttcatgattttctcctcttttcttttttttagtatatccgtttttgagttcttatataggcaagtcttttttagccggctgttttccacaaaatttttttatggaataaaaaaggcactaaccctacacaaatatctcaaaaaaaatatttatgcacagttaatgcctgcttactcagtaacacactatgactgagattacttataccataatttaaggttgaagtcaatcatttttgcaaaaaaatcatctttaattagcaactggaaaattcaatacaactcgataattccacaatatcatcaataccgcactttagaacattgcatatacgttctaagttttcaagaacattttaccaacaaatttatttaatccgtttctggatatcctcaacagatggtaattgcttttccaaatcatccggcagattactggttattttgtattcgctcacacctatcggttttgaaacatccttaagtgaatattctgcaaccacattattcttacttttacacagaagcaaaccaatagacggattgtcctgttcttttttcaaaataccgtctacggctgacaaataaaagtttagctgaccaacatattccggtttaaagtcaccggttttcaattcgataaccacataacagcgaagattcaggttataaaacaacaaatcaatataaaaatcatcaccgcccacattcaagtgatactgatttcctaaaaatgcaaatcctgttccaagttccagaagaagttttgttacatcccgaaccaatgcctgctcaatatctcgttctagcatatcttccttaaaaggaatgaaatcaaaaacataagggtctttcattgtctgcatcgcaagttcactctgcggagatggtaaacgacgttcaaaatttgtaatcttgtctgccagaacctgacgttgatacaatctactttcaatctgatggacaagaacatttcgtgaccagccgttttctgctgacttttgaatataccatttgcgttcatctatatcagcaaccttatccataagaacaatattgtgaccccacggaatttgtgcaacaacctgttgcacaaattctcgttccgaataagtctcagcgaattttgccatatactttaagttacgaacagaatagcctttgctttttggaaacgctattcgaatatctgctgcaagattatcaataaatttgtttccccacaatttatgttcattaatcacacaaccaatatcataatacagtagtaacatgtctgtattcacatgaactgccgcacgatattgtgtcgcagtaatttcactcttaatattttcaataacagaaagatactcctgcgtattcattagcacacacatcgcctcactttcacatcatttttatcattatttttttctcttaatatgctaatatgctcttctaaaaagacaatcgcactcttgttatctgctgctgatattatcttaacttacctactaaaacttatcaatccaaatttatattttctctttttttacctcaattcacaattcgataatactctttcgcagtcaccccatacacaatcgcatagaataccgcaaacaccaccacactcacagccgtacattctgcaaacagcgtttcatttgccagattcagcaccgccagcagtttagtcataacaggaaatgcaactgccacatgcaagattgcaacgccaagtggcaagaagaacacgcttaacacctgactatgaattgcttttttgacttctcgtttactcattcctactttttgcataatcttaaagcgttctttatcgtcatagccttctgaaatctgtttataataaataatcaacaccgttgcaatcacaaacatcattccaagatagattccaataaagaagaatgaaccatacaaactatagaaagacttttcacttaaaatccggctttcaaaattaatgttggtattttctccgaattttatctgcattgcttctaaggcttgtttgcaggattttttatcaccttttaaatcaaatccaatcgaataagaaacatctgtcatcgcttttgcagattcttcttcctgtccattttttaatgccagttcttttgtcgcttcggaaaactggcgtatctgttccaactttggaagaatcacataaaatgttccataagtaccggctttatttttgggttctgctttcagcgtttttaattctttctggatttgataagttgttccatttatcgtaatctgagatgcaccataagttctatctgtgcaatataataatgcctcatcttcatttaaagaaacattctggtgttccatctgattatattcatccaccggaattaaagtcatcccacaaattccaaaaacggaaaaatcagatgccggtcttaaggtaaaggaagttccttttgattctgccataagaactgccccatgataggtaatctcagaagtttctgtcacacctgctttttctgcttcatcctttattatctgtcttacctgttgttccgtctcttcatttgttgaaagaatctcaacctttgccggacttggaaatcttacggaaagaatatcattcattcccatatataaggatactgtcatggaaattagtacaagcaccatcgtacttaaaatacagatatttgcaagtccgactgcgttttgtttcattcgataaatcattcccgaaactgccgtaaaatgatttgccttgtaataatatctcttatttctgcgaagcaatttcaaaaatgcaatgcttcctgcggtaaacagcgcatacgttccaataatgacaagaattgccgctacaaaaaacactccaagtgccgcaagcgggtcttttgtggtaagcgccagataatatcctgccgagagggttgccactccaaacagtgccatcagccattttgtctttggttctcgttctcctgcatttcctccatgaagaagttccaccggattagacagacgaatctgaatgatattatagaaataagtcagtaaaaagattgcaccaaataccacaagagtatccactaatgccggctttgaaaatgcaatgtttaagcttgcatttcgatgcagaatttttaaaaacagcagatacatcaagcgattaaacagactgcccagtccaattccacctaaaatactgataccgccaatcaacagactttcaattcccatcatttttgcaatgtgaaattttcccattccaagaatgttatagacaccgatttctttttttcttcgcttaattaaaaagctgtttgtataaaataaaaagataacggagaaaatcaccataattccggctgcatactgaaggcagacctgcatcgttccttctcctgcgatttcttttattctgcccaaagtatcaatcataaaaaacatcataatacttaaaatcgcagttagcatatagggcacgtaagttctacgattattttttaagttcgttactgccagacgaagatagagtctcaatgtatttcaccccctgttgtaagtaccgtaagcgttgccgaaatcttatggtacatctcttcatttgtcatatttccacgatacagctgatgaaagacttcaccatctttgataaataacactcgacttgcactgctcgctgctttcacgctgtgcgttaccatgacgatcgtctgaccatccatgttaattgtatgaaataaatgcatcaggctgtctgctgccttagaatccaatgctcccgagggttcatccgctaaaatcaactgcggttttgtgattaacgcacgtgcaatcgcagctctctgtttctgtccgccagatacttcatagggatatttttccaacaacattgtaattccaagtttctctgctatcgtagcaagccgtctttccatttcctgatacttctttccggaaagcaccagtggaagaaaaatattatctttcaaagaaaacgtatctaacaaattaaaatcctgaaaaacaaagcccagattttctctgcgaaaagctgagatttctttctcacgaagccctcccaaatcacttccttttaaataaacctttccctgcgtcggcttatccagtgccgctaaaatatttaacagcgtcgtttttccagaaccggactctcccataattgctacatattctccctcttccacagaaaacgttacattttttagtgcttctacctgattctttccaaatcgggtggtatatattttcttcacattctttacatccagtaatgccattttttctcatcctctcttgttttgttcgtctttatttctttaccttacaatgcttattataaaaaaagagaaaatgtattaccattgaatcaggttacattttctctttgaatcttacattgttgtaaggttaaaatttcactgtaaaactaaattttttattcttcataattttgtcatacacattaaaatagatcaatacttttttaatttgaccatacatcaccaaattagtataataaatttatagaaaataaacatccaaaagggggatttttatgaaaaatcgcatcgttttacttactctatgctgtgtatctttattatgtattggataccctctatctaagaaaatttcttctccttcaaaatataaaacggttcaagtatctgaaaccgacaacacaaaaacttccgctgtcaaccatacacaggaggatacaccaaaaagctccgtatcgaaagacaaaaatacttctgagtccacgacagcgccagaatccactgattctattgattcttcagaaaccaataataccgtaaacaataatgattccactgctccttccgctgcagaatcattgaataattccggcaatattgccaatacagaaacttacgataactccaatataacattagaatcagagcaggaaaatcagccagtcaatattgaaactgccgacgatacaacccaaaccgaccccgttgaagaaaaccaaaataatccacttcaaacagtacaggcttatgttttatccgtagatggcactacgatgtatgtagatttagaaaatccaggagcaagaacttatcctggagagggcgaagaacgccaaactgcttttgatatttcaaatgcagaacaaattcaaacagaaatcagtgacgtttatcctgcaagcaatcattttatttgttcctgtgtttctgttgaaatcgaatattatacagaaaatggagttaatattgcgaccaaattgacctctaacggtcaggaaattgcaccactttactttaaagaataacagtcattagaatctctaaaacctaaaaagagacaaatgcagtggctttttcatcagcccctgtacttgtctcttttctctctcactgaaaattcctctgtgatatatctttatttcttatttttctattccggatgcagttcttctcttgccagtcccaaaaacacctgtgttcccacacccactttggattctatccgaatctgatgccgtaaccgtcccatcactttcttacaaagatacagcccgattccggtagattttttatctgccctgccgttatatccggtaaagccccgctcaaacactcgtggcaaatcttcttcccagattccaattccattatcctcaatcacaagccataactgattggattcctgttttgtaaaaatttgaatcgttccacctttttcagtgtattttaatgcattggataaaatctgttcgattacgaaacacagccattttttatctgtaatcacattctgattcaccgcctgatattctaaccgaatcttttttaagataaacatctgggaatatttgcgaatacttgcccgaattaaatcatcaagcggataatgctcaaatttcaaatccgaagccatatcttccattctaagatacgtcagcaccatttccacatactgttcaatccgaaacaattccgcttttaattcccgtagttttttctcttctggatactcctcttccatcgtttgtaacagcatccgcattgcagatattggtgtcttaatctggtgcacccacatcccataataatcctgcatttcctgtctgaaaatcaattcttcggattttaattttcttcggatttcttctaatttatcaagcaaatcctgataatcattttcaattaaagtatccggttccggcaaatccagaagcgcatcctgcatatttttctctactaaaacaagctctttatgcctcttataaaactcgcaaaaatcaatgaaaaataaaattccagccagtacaagaaccagcaaaaaaccataattcaacgcatcagatggaagattatagaggaaaaatacaaatttcaaaagtgccagcgttattatataaagcaaaatttcccttgcccgctcttttaaaaatcctgcaaatattctcattttgccaccatatatccgattccttttttggtctgaatcacttcttttagaccaatttgttccagttttttacgaagccttgtcatattgacggtcaatgtattatcatcgataaattcgtcactttcccaaagtcttgtaatcagtgcatcccttgatacaatcttcccggcatgttctaacagcatctgaaacagacgaaattcattttttgttaattccattttattctgctcatactcaattgttgcatcagcaagatttaaatatgccccatgccattgcatcacatcgacactgccctgaaattcatacgtccgtctgagcactgcctgtacttttgccgtcaccacatttaaatcaaacggtttttcaataaattcatctccacccatgttcattgccattacaatattcatgctctcgttagccgaagaaatgaacagaaccggcaccttcgatacttttctgatttcctgacaccagtgaaatccattgaaaaatggaagaaccaaatctaacagtacaagctgtggctcaaattttaaaaacgtatccatcacatttttaaaatccgtcacaccctccacctgataatcccatttttcaaagtgtgtttttagcccatctgcaattacaacatcgtcttctacgattaatattttatacataatgtcctcatttattataattcaaacgcttccatatcatccggcacatagagatttccatgataataggcttttccttcttccgtataaagtgccttccttgctttgatatttttatcttcggtatgatataaaatcagattttccacccctaatttttctgccagctcacaggcatcttttacggtagagtgatttttttcatacggatggaaggtatctcgctgtccatacaggcaaaatgcttcatgaagcagccatttactttgtcttgcgtatttttcttcccaatcgcagtatggttcatctccacaacaggttaacttctgtccttcttctaattccatgctaaatccaaactgttttgctttagtagaatgaatatcaaaaaatgtcactttctttccaatgatttctttttcctctccatcggaaaccacaaccagatgtactctctttccaataaaatcggtctgttttttctggagcagtttttcagcaagttcctgaattaaagaaatcacttcttcatgtccgtaaatataagcatcaccttcataagcacctttctgcatattttggcagataatacgggtcatccatacaattcccaaaatatggtcgatatgtttatgagtcacaaaaatatgatgaatgtctgagatagaaatatccgcatcttttaagcgttttaaaatttcgcttccaccgcctccatcaactaataaatattgcttctcattttcaattacaaaacaggtattataaacttctgttactaatgcatttcctgttccaagcattgttaatttcatttttttcttcctttctgttttatctgtttaactttgttgttttaattcccgatgtaccttttttcttacaaaatagaagcaaactgcctgcatcaaaatcgtcaatgtccaagacgccggatacgacacaaataaaatctttaaggaacgatgagccgggaaaactccaaaaatccacacaattcttgttccaactgttccgataatcgataaaatcattggcactgccgaagctcccattcctcgaagcgcacccggaaataaatccatcactccacacaaaaagtatgtcaccgtagtcagtgctaaaatttccagaccacagcgaataacttccggatcttctgtataaatctttaagatttcaccaccaaatgcataggaaccacatcccagtacaagtgaaacacctacacttaaaataatacagtctatcattactcgatccattcgttttggcttatttacaccataattctgacttgtaaaactcatacacgcctgtgtcaccgcattgattgacgcatataaaaatcccagaatattatttgccgccgtatatccggccatcgctgttgaaccaaatgagtttacggaagactgcaaaagtgcattggaaaaattaatgaccgtactttgcacccctgcaggaattccaacctgaaaaatctgtttcagatactcttttttcattcttaattttgaaaaacgaagctgataacttccttctgttttataaaggcaccacagcactaaaacgcaagaaatcagctgtgaaatcactgtcgcaatcgcaacacctgccactcccatgtcgaatacaatgactaaaatcatgttaagaattgcattggtaacccctgaaataatcaaaaacatcaacggacgtttggtatctccaacagctcttaaaatagctgctccatagttataaagcatgaaaaatggcatacctaagaaatagattttcatatacagactcgactggtctatgacatccgccggtgtccccatcagttccagcgcccaccttgaaaaaagcagtccgactatcgccattgcaattccactaatcaacgccaacaatatcgaagtatgtactgtttctgacatttctttttgtcgccctgaggcataaaaacgtgcagccaacacatttgccccaagtgatactccaataaataaattcgtaaacacattaatcaatgccgtcgttgaaccgaccgccgcaagggcggaacttccactaaaccttcctaccacaacaatatccaccgcattgaacatcaactgtaaaattccggaaagcataagtggaagagaaaacgaaatcaatttgtccataatcgagccattgcacatatcaatttcatatttattttgtttcatttttatctccatctcccgtcttttttttacttctctttatcagtatactatacaaaaaattgcaatacaatggagaaaaaatcaaaaaatcaggtaggaaaattcctgcctgattctttgactacttattcaatttaatcacaatatctccgtcatctgcctgtaatttcagattgccatcttttccatttctttgataactgctttcatccacatcttcttcatgaagctttccttcaagaaaatccggtacctcaatatcgccaaaacctgtagatgcatcaaatccaagtgttaaaagctgttctttttttgcttcaatatcaatatctccaaagctgctggaaatggaattttcaccagtaaactcactatcttttgcgacgaaatcaccatcggaaagttcaaagttacaagcttttatcttagaatcatacgttttcacatcaccaaaagaagcggaaacggtgacatcttttaaagtactattcttaataaaaatctctccatcatctgatgaaatctttccactttcaaagcaactgctattaatcaggatatcaccaaatgaactgtttatatttgcagactgaaatcttgcatccgttggaacatataatgttacaacattttcatccgtcgtaaagtctttgtcttttgacaggaatgctgtaagaaatccaatatctatatgtgtataagaattggagtctgaatcttctttaagcgtaagaattttatttttcacatcataagaaaccggttctttttcctttgaatctgaagtcgtataactgatataatacgaatcatcatcagaagatacaatctgcaagtttaaagaagaaagatccacgtttaatgtgctataatcatctatctttgttttttctaatccataagttgaatcttcttttgttgccgaacctttccattggtttaaatcagcggcaagcacataattttttcctccgttcaaaaatccaactgcaaagagaagtgctcctgccacaacgcatcccgcacctgctgcaagacaatttttaatccatcttttcatgaatccttcctccttttctaaatctctttgaacgtcctgaaacccattttgccaatttcacgaataataatccaatcccttttgcaagcgcaacaccaagaataatgctaagtattccaagaccaaccacgaaaagtccgcttccacttatgattgcaaatcctggtacggaaaacggaattgctaaaattccccggataaatagttttgccccgactaaaaagaaacaaaatgcaaaaataaaaatacatagtactatgactccaagacaaattaccaatgataatacgactgcaaggaaagcaattgcaagcggtgcaccaatcggtgccgcacaaattgcaaggcaggctatccaaaagagactccatttcgatgactttttggttgtttcggattccgacacctgctcctctaacttcctatccagaagattagaaatcaagtctcttgctgcttcttttggagttccaagttcgttcattaactcctttgcgccctcttcgtctgtctcttcaaaatattctgtgaaatactccatcgcatcttcataatcctgcgaagaaagttttttcaaatatttttgtaactgttttaaatattcttctttactcaacttcgaatcctcccctctataattccgtcaattgtatcgcaataggcaatccactcatggctaagatattcgatttgctcttttccactttcggtaatcgaataatactttcgttttcttccctgaaactcctgtgaatacgtggtaagaaatcctgccttttcaagttttttcaaaatcggataaagcgttgattccttaatatccgccaccagtttaattgtctgactgatttcgtatccataagagtcctgagtttccacaattgtcagaatcagatattcaatcaataaagcagaaaccggaaaatacatgcaatcatctccttttttaatatgtaaaatatttatatatataaattttatatatagtatagtgccagaacatcgtattgtcaatatatatgtaaaaattttatatatatattctttcccaaacaaaaatacaggattccagctcactcatgagccagaatcccatactctttcggtaatttcatttctttatgctgatataaaattttttccaattcataaatcgcaggtgtcagaaatttatttttatgatacaccaacttaaatttgcggttccattcctgtttttcatcataaaacacccgaattttttcatgtgccagctcatgtgttaaaagacgaagcgacataacagaaagcactttattccaaatcactgcattgataatcgtacgtggacaatttgcctcccacgttaccttgattgaaatgtgatgccgtttcacatagtcctcaaaaagctgtcttgttccgcttccctgctcacgcattgcaaagcactgaccatttaattctgaatttgaaatttgaattttttcaaaaaatggatgccggcttccacatccaagtaccagacaatcctcaataatcggaatcacaaccaaatccggcgactgaatttctccttccacgactgccgcatcgagttcagatttcaataatttctcttcaatttcatgcgtattgctgacaaaagaatacacctcaagccccgtcagactctgttctaattctccaatcaaagttggcgcaaggcaagttcccactgttaaagtcgttcctagctgaaatcgctcattttgtccctgacttagcattagttcctctaactgttcaaactgactgaccaaatctctggcatgagaaagtaatagttttccacgctctgtcaagtaaagtttctttccaaggcgttcaaacaacagcccatgataatgctgttccatttcacgaattgcctgactgacggtcggctgtgaaagataaagatgttttgccgccgcactcatcgttccatactctgcaacagccaaaaaaatcgtaaggtatcgaatcgtcattgtttttatcattcccttttatctataggtaaaacctatcatttttataaaataatatcatttttcaaatacatcaacaagtgttatattatagttattaaaactggtacattgaatattaagcagctgctatatttacgctgtactggtacataaaaagctcaaggaggaataaaatgtcagcattaactgtcagcaaagaagaagaaaaacgtttaaaaggacttggcttcttaaataacaaaggaaccgataacttttctgcacgggttatcactgtaaatggaaaaatttctgctgctcaggctcagtgtttaacagaagccgcagaaaaattcggaaatggagtgcttaccttcactacccgccagactgtagaaattcagggcatcccttatgataaagtagaagcatttcaggctcatcttgcaaaagaaggcttaaccgttggcggaaccggtccacgtgttcgtcctgtcgtatcctgtaaaggaaccacctgccattatggtctgttagattctttcgcaatttccgaggaaattcacaaacgtttttatgagggatatcatgaagtaaaacttcctcataaatttaaaattgccgttggcggatgtcctaataattgtgtaaaaccagatttaaatgaccttggaatcattggtcagagagttccaaactttgataaagctctttgtaaaggctgtaaaaaatgtgccatcgaagcagtatgtccgtccggtgccgctaaagttgttgacggtgtcttaaacattgataaaaaggtctgtatccactgtggtcgctgtgttggaaactgccattttgacagcattaaagatggtacttacggatttaaaatttacattggcggacgctggggaaaacagatttcacagggtcgtgccttaaataaagtctttacttccaaagaagaagcaatggatatcattgaaaagaccatcttattcttccgcgaaaacggaaaaccgggagaacgttttgcactgacagtagaccgtcttggatttgagaatgtagaaaatgaaattttaaacggagacatcttaagcagaaaagaagaaattttaaaacgtgaactgtaaaaaatcccccgaggttgttaccaaaaacaacccagggggattttttatgctaaatctattaatttaattatgctaagtattcttttaatgttgctcttactgcaccaacacctgcaatctcttttacaaagatttcttcaatcagttcgccgataccagctttgtagaggtcaattccgaagatgttttcattagaaagaatggatttaagctgtccgttgtagctttccggtttgccaaattcgattccttttaattctgcttttaattcatccagcattgggtctgcggaaagttcaaacgcttctccattgtcatcaagaccaagaagatatcggcaccatccagcgattgccagcgggattgcttttaatttctttgcatctccgtatttttccacataagatttgatagtttctccgtaacggattccaactttctgagaagtatctgttgcaatacgctgtggagtatcaggcataaatggattcggaatacgagtgttgataacttcgtctacgaactctgccggagaaaggatacccgggtctgtaacaaccggcataccttctacaggaccgatttcatgaaccaatttgtttaactgttcgtctttcatttcgtctgcaattaaagtatatcctaatacacatccgtaagtagccagtgctgtatgcagtggatttaagcaggttgtaactttcatacgttctactttgtttacagtgtcacggtctgtcatgtaaacacctgctttttcaagagccggtctgccattcgggaaacggtcttcaattaccagatactgcggtccttctgcatttacaaatggtgcaatataagttctcttagaagtaataaccggtgcaatgtcttcgattccaagttcctctaaagatttgcatacagattctgccggtcttggtgtgattttatcaatcatagaccatgggaaagatacctgtgcttcatcggagatataagctacgaattcatcttctacgaatccttttttgttccattcttctgccattgtaagaatagaatttctcagtttttctccattgtgagagcagttatccatagaaacaacagctaacggagcttttcctgctttgaaacgttcatgaagcagtgcgcatacaacagccattgcagaacctgctttttccggaccattgtcgatatcgctctggatgaatgggaaataagttccatctgcgccttttaatgcataacctttttctgtgatagtaaaggaaatcatctgaaggtctttattctggaagatttcttttaaacgattccactcagcctctacattagactgtgctttgattgcctctgttaaagaagcgattacttttttatctgtacttccgtctgcttttaaggtaacacccagaaccagattgtcataaggagcgtagattttgtccactacatcgaagtcaaatgtctctacgcaggtaatacctttgtccatagctccgttggaaattaaagtatctgcgattccaccaatgaagatacggaaaatatttccgattccgaaatgtacccaagctggggatttctttgtttcttcttttactttttcaatatcataggatggaagcacaacgcctgctgcttcccagcttttcttatctttaataccgtctaatgtcagcttcatcttcattttcacctttctattcttatttactataattatttattttcgctttttgcttctttttcgattgcttcccataatccgcaaaggtaagctgcaccaagtgctctgtcatacagaccgtatcctggcattgctttttcgccccaaatcattcttccatggtctggacggattggtccttcaaatcctgtttcatataaagctttcataactgcatgcatgtcaaatgttccgtcagagcttaaatgagcactttcttcaaaatctctcattccatcattaaaacgaaggtttctgatgtgcgcgaaatgaattcttccttttaacatcttaacagttgcaactaaatcgttgtttaagtttgttccataagaacccatgcagaatgtaacaccgttgtgtttatttggcaccatttcaatcagacgttttaattttgcctgagaagaaatgatacgtggaagtccaaatacgctccatgatgggtcatccggatgaattgccatgttgatgtcgtatttgtcacaaaccggcatgattgcttccaggaagtatttcaggttttcaaacagtttttcttcatcaatatctttgtaaagttcaaacagctcttttactttttccatacgttccggttcccaacccggcattacagttccgttcatattgtttttgatagcgtcgaacattttttcaggatccatgctgtcgattacatcctgattatatgcaagaacggttgttccatcttctctcatacggtcaagttctgttcttgtccagtcaaataccggcatgaagttgtaacataccatgtgaatatctgctttaccaaggttctctaatgttttgatgtatgcttcgatgtctttgtctctgtccggaccgccggttttgattgcatcacttacgttaacactttcgatacctgcgaggaaaagtcctgcatcttcaacatcttttttcagtgcaaggatttcatccaattcccatacctctcccggcattttgttatacagtgtggaaataattccttttacataacagctctgacgaatctgctgtaatgtaactgtatcatactcttttccataccaacgcattgtcatttccataataaacattctccttatcattttgatttcttattttatgttttcagtttatgtgtatctttttctcgtatactagtatggtagtataaactcaaaattttttcaattcacattttcactatatatttttttatttttctgtgtattttgtacaagtttttttattttcagtttaaaccattgactttaagtctcgattttcagtatactagtatgtaagctgttaaaaggataacaaactctaattttcatctggtaaaaaacagtttcatagcgtataattagaaattagggtatcatttctactattagcaaagagagggtattttatatgataatacttaacagaaattcttctgaaacagcaagatcctatgccatgcgggttcttttatataacattatccacgttgaacttcagcccggaagtgcagtcagtgaaaatgaactttcttctgccctttccctttcaagaaccccgattcgtgaagctttaatcgaattaaaccgtattggacttgtcgaaattcttccacaaagaggaagttatatttctaaaattaattatgcaattgtcgaagaatcccgttttgtacgtcttgttatggaaacagcagttatcaaacttgcctgtgagtctattacagatgactacctgcttgcactgaaacaaaacattgaacagcagaaagcctgccagactaccaaagacggagaccgttttcttgaaatcgacaatgaatttcatcgtcttatttttgaatgtgcaggcaaaatgtggtcctatcattttgtagaagaacagatggttcactttgaccggcttcgtgcacttgcagcaaaatccggatatgcgaaatcaacgattccggatcacgaagatattttatatgcattaaaacgaaaagatgctgaaatggcagaaatttttatgacccgacatttgacccgatatcagacagaaaaaacggaaattatgaaacaatatccggaatatttcacgaaataaaaaacagaggtgtatcgtttttaagcaatacacctctgttttattttttatctattaagtttttggcacatcaacaatgctcaagatatgacgcagtatgatttcttcatattatttcataattggttctaacgctttagctaatttctccttctcagcctctgcttcttccagattctttccaagtgttgtgtaataaatcttaatcttcggttctgttccggatggacgaacaacaacagtttcaccgttatcaagtttgtaaattaaaacatttgcagatggaagtcctgtttcttccggttttgtatagtctgttactttgacaatctgatgtccggcaatttctgtcagtggtttgtcacgaagtccctgcattaatgcagacatcttgtccattccactcaagcccgggaattcaaaactgtctactttatttaagtaacgaccatactgtgcgtagatttcttccattctctgttttaaggaacttccgatacttctgtagtatgcagccatttcacaaatcagcatagaaccgattacagcatctttatcacgtacatacggtcctgcaagatatccataactctcttcaaatccaaagataaagcggtctacttcaccagcttcttcaagctgtgcaatctggtcaccaatccatttaaatcctgtcagtacgcttctgagttctactccgtaatgctctgctactgcatccgcaagtggtgtggaaacgatagattttactgctaccggattcttcggcattgtgcctttttcgatacgacctgcgcagatatagtctaaaagcagtacaccaacttcatttcctgttaccagttcataggagccatccgggcatttcattgcaataccaacacggtctgcatccgggtcagttgcaagcattaagtctgcacctgtttcttttgccagatttaatcctaattccagagccgcaaaaatttccggattcggataactgcaggttgtgaagtatccatttggatattcctgttccggaacgattgtgatatctgtaattccgatatcttttaatacctgagtaaccggcacaagaccggaaccgtttaatgggctgtaaaccagtttaagacctgctgttttgcaaagacccggacgaacctgacgagattcgattgcttcgtaaagtgcttttttgcagtcatctcctacaaaacgaatcagtccttcttccacaccttctgcaaaggacatatatttggcacctgttaatacatctgttttctgaatctcttcatatacaattgcagctgcgtcatctgtcatctggcatccgtccggaccataagctttatatccgttatattttgccgggttgtgagaagcggttaccataatacctgcgttacattcatagtaacgtgttgcaaaggaaagtgccggtaccggcattaaagcgtcataaattctgactttaattccatttgcagccagtacacctgctgcattttttgcaaatacgtcactctttaaacgactgtcataactgattgccacagtctgatttccgccctgtgtttttacccagtttgcaagaccctgtgttgcctgacgtaccacataaatgttcatgcggtttgttcctgctccaagtacaccacgaagtcctgcagttccaaattttaatgctacagcaaaacggtctttgatttcttcatcgattcctttaatttttgataattccggattcaaatccgcatcttcaaggtctgctgccagccagcgttcatattcttcttgatacatttttaaccactcctactattctattttttatgtatgtataaaacgtaactatactataccatatttttggtaaaaccgcaataaagccggaggactttgcacctatttttgtgctcttttttcgacaaaatatacaatgattattggttttctattttttctcaaacttttaagttctccccaaaaaccctaaaaaaataagttgcttctacagactgatgcagaccctctttctggcggttttcaatcatttgatacactcgttcatgtgcttcatacaattcttctttccttccggactctaacattccctttactgattcatatctcgtagaatatgtgagaacgcgcataattgcgtttattttagaaatcatagagttatgtcccatatctgtgattgcatcatgaaactcgttatctgcctcaaatacagcatctacatccggatgttctaccataattgtttcttttaaatgaatcattctttctttcagctgtgcaatctcttcttcactgcatttttcaacagcaagacgcatcacacctgtcgctaccattgctcttaattcatgcagttcctgttcattttgctgattcaagataattccataaatcattgggtcaatcagactttctgagaagccattacatacaaaagttccttctgctcttttaatttctaataccccaatataaaccagaatctttattgcttcacgtatggaattgcgtgccactcctagctgctctgacagctccatttctgtaggaatcttatctcccggttttaattccccactcagcatcgcctgtgtaagacggtcaattacacgctgtacaactgatgaccggttaattttttttaagtattcaggcatcgctcatactcctttcctcgtttttgtgtaacattggatgttgttcattccattatacttggtacgattcgataaaacaactaatttattcgtgatgtacaccaaaatttttgatattcacatcatactttaatcgaataacagaccagatccaacaaaaatccggtcgtttgcaagcaaaatcgcctgcaaatgccggatttttaatatctttttattcctcatcagccctaaaatttgtttaggggagattttttcgaaagttcacaaccatggcatccctgccatggcaaatctctttttgttttttatgttctaatttactatcttaatgcaccatcggaaccaaagttatatttctttcctccaatagtctgccagccggttctcattgctccgtcatttgctccgccaaagtaatatttctttcctccaatggtctgccagccggtcttcattgctccgtcatttgctccgccaagataatatttctttcctccaatggtctgccagccggtcttcattgctccgtcatttgctccgccaagatagtaccatttgttataaactttctgccaaccggtcttcatcgctccatcattttcatgtccgagccaataatatttgccatagatcttttgccatccggtcttcatcgctccatcattggagtgtcctaaccagtaatacttaccatatactttctgccaacaggttctcatcgctccatcacttgccaaccagtaatatttaccataaactttctgccagtaagttttcatcacaccgtcattaccaaaccagtagtaggaatcatagatataattccagtaccgagccatatctccatattcatcaaaataatgagcttgatcataaatatcccaataccagtaatttgtcatcggaattccagaatcatctaagatgtaagtatgattgattccatctatttcaatttcaagcattttataggacatgtattccgatggaacttcaagcccttcaattgggaacccttcatcattatcatagtctccctctgccatataataatgataactgtcttctcctgtcattccatccgaccatataagatagtatcctccatccggaattcctgccgatcgatcagagtaatccgcaatcagacgatatcttaaaggaatctctccgaattcatattcatatctgagtcctaccatgtatgttccggtgtccagcgtatccggcactgcattcggagcatcactattataacatctccagcgcttgtcatttgctgtataaacccatttgctttcaagcttattcttcgtatgtgcattatcataattacgatagattactttttgaatttctccactgtaaaaattagttacaatttcctgtgtccactcatcgccttgcaccacttcaccggtcgacatttcatcggaccagccagcctccacagcggcggctgctaccggtgcaggtacaaccgaagtgacccccaatccaagtgctaaagcaactgccaatccccctaatctttttctcttcataacgtttcctcctctcggattattagtacttatattgtactatattcttcgaggttttccaacgttttttctgaaaatttcttaaagctttttgattttaacaattattttcattaagctttttttctgtcgcacgaatccgaatataataactaatgcaaagtaacaatgcagctccactccaggcagcaatctcggcaaaaaagattccattttgaccgataaaaatcggaagaatcaaagccgcaccaattcgcatcaagaactccgcaaatccacttaacattggaagcaaggtatctccaagtccctgaagtgccgaacgatacacgtataaaaaatataacacccacagcatcgccgccataatagaaagataatgaaacgcaatctcaagtaccgcttcgatctgctgttgctctccggagaggaacaaggataagattggtttcccaaataaaaacattgcaacggaaatcacgattgaagtcgcaagcgaaatcaaaagactgacccgaactccacttttaattcgatcaaattgctttgctcctaaattttgtccgacataagttacgattgcataaccataagaaatcgctgccatctcaagcaagccatacaacttattagtcgcagtaaatccggcaacaaataagaaaccatagccgtttattacatactgaacaaccaagcctcccactccgataatgatattttgaaaaactaccggaattcccagttgtagtaaatttaaatccagttttgcctcatgctcaaaatccgattttgctaactgtaccagcttaatttgttttaaaattgcaaaacaatagattgcagaaaacagctgtgcaataattgttgcgattgctgctccggcaattccccagccaaacacagcaacaaacaataaatccagtacaatgttgataagcgatgcaatcagcattgccgtcaatggtgctttactgtttccaattgcccgcagctcacaggcaaacatattatatgccgtcgtaaatggaattccacaaaagataattcgcagataaagcagcgccattccaatgatgttttgcggggtatgcagtccggtcaatgccgctgaagccaacagctggctcaaagcaaaaaccaaaacggcagtaatcgcagttaaacgataactatgcgcaattacttttcttaaagcgactccattgcctgccccgtaatgctgcgaaatcaagattgaaaatccctgcgtaattcctgttgaaatgcctgtcacaatccacattaaaaaatcaactgagccaagcgctgccaaagcctctacacctgcaacctgaccgacaatcatagtatctaccatagtataaagctgctggcaaatgttcccaagcattaacggaagcgcaaaaaagaagattaattttgcggcatttcccgaagtcatattttgcgtctgtgccttcataacatctcataaatcctttcaaaaaatacgttttttatcctttcagatattaactctattctaccatattgccctgtaaaacggaagaaaagggactgaaattcactccctttttttatgtgtttttttctccggaagcaccaacattgcaagcgctgctaatacgataattaaccctgtaatggaaagcacagttgggatttctccaaaaaagcaaataccaaataccattgccgcaaccggttcacatgagcacaaaatggatgccttacctgcatccatatggtccagtgccactgtgtaaaatgcatatggagccaccgcaacacataaagaatgcaccaacataaaccccgaatgcggtaacggattttgcataatatactgcgccacatcgccccattttgcaaacggaagcaggattactgcaattgaaaggatactataaaaagtaatcgtaagcgccggatacccacgtctcatcccaactttagaaaagatgctgtacatcgcataaaaaatggcgccgacacttccgactaaaattccaatccaactccaatgcatactctcatttgtttcaaaaatcccacttgtcaacacgcagccacaaattgctaaaaaaatacttaatacttttcttcgcgtaatcgcttcatgaaagagaaaaaatgcaacaatcatgaccacaatcggagaaagtgcaagcagcaccgctgcaagcgaaagcgacaactcattgatagcaaaattgtaacatacattcacaccaagtgacccaagaagccctgctccaataaaaatccagcaatcttttaaatgaattttaaaatactccggatgcgaatacgcaagccagattccaagcaacagtactgcaacaatcaatctcgaagccacaattgtggtgttattcatatctccgctcaatttgcgcacaaaaattccggcagaaccaaaaccgattccggtaataatcggcataaaaccatataattttttcatctttttaccaactttactctcattaacaatattttttcagaatttcatgcatcttttcaaactgctcttccatctcttttaccagacgaaactgcgttcttgcgcgcaccagattgtgctccggatatgatgttttaaagtatacatcaccctgaaggaaatccgcaagaaaacgcattccacactctaaagtcatcaatctggctccccatggaaggctctcaatttctgccggagtcagcacatcttttgccatctccagatatcccttcacatagatttcataaaggtcgatatcaaagtgtactttgtccaaatctttttcatcttcttctgcggtagaggcaccaaaacgaatggaatcgccaaagtcgttacacgcaagccccggcataatcgtatccagatcaatgatacataagccctgatccgtatctttatcaaacaaaatattattcaattttgtatcattatgtgtcacacgaagcggtaagactcccttttctaactgatccatcaaaacattacaatctgctttacgagaaagcacaaattcaatctccggatggcataatttggcgcgatttttcacatcttttcgctgcgcatcttcaaaatcacgaaaacgctttgcagtgtcatgaaactgcggaatcgtctcataaagactgtctgctggataatctcccagttgctttaagaaatgtccaaaactaagtgcagattgataaaactgctccggacgctccacctgctgatagcacacggaattcggcacataatgcagacaacgccatggctgtcccttctcatcctcaaaataagtatcgccactctttgtcttaatataagataaggattctctgtctaaatcgccaccgtcctgacgaataatattacgcaaatattccgtcactccaaaaatattttccatcacctgatctggatttttaaagacgttaatgttaattcgctgcaatacaaagagcggcacatcatttccattttcatccggcaaatagactgcataggtctcattaatatgaccttctccaaatggctttacatagctgcagcaatcgccaaatccaaacgcataaatcgcatcttccagacttcggctatctgcaccttcgatggttcttctggtagagaaaatcacttctcctgcttccacttttctgcccggctcaatcacacaatgtgcttttactacgctgccaagaccaacatgtgcgccttcttctacaatcgaatcatggtctaccactgcaccgctgttaataagtgctgccattttgattgttgtattcatatttaccactgctctttgcataacaaaacaacccggctctaagcggacactcggactgacgattgcagatggatgtacgattgcaggtacttcatactcctcttcaagcaatttttgagtccaaaataaacgcgtcttgttatttccaaaagctgctaccgctactgaataatctctatgatacagatgataatcgcagcatctgccaatcacatcatcatcctttgcggtatcgtctaaaaataagacttcctcataaccaagtgccaatgcggtttcttttatcattcttccaaaaccgcctgcaccaagaattaataaatttttcattttcctctttccttcttttttatcttgagagcgtacgctccgatttgtattctataaaatttataaacgtaaacctattttatcatctacttctcttttttttcaataatacttattaacacttattgaaaaaaccttgaatttgcccagaaatttccttttgttcgaacttatcctgcaaacacttcttccaaagtctgatatttaaataccggaaaatcgttctcatcataatgtactttcattatcatagcatgacggttcggatcatacaacgggtctcccacaatttcatcataaggtcttgcatgataaacacacaggtctgtcactccatcttctgcttttacaaatgagttatgaccaggtccaaagactcctgctgcataatggatttggtaatgcaatcgaatatcttggacgatatacccacaaggttgctatctctaacagccgaatcatctctgtcacggatacacacacaacattcactgcccgtggcagaaaaccaggtgaccctcgccgtacgattaccctcagtaatgaggagtttatcaggcgcttcctcagtgaagaaatctgctcttcttaactactctgaatctgatactttcctaatgaattataacatgaataatcggtatctcatagataaaaaaggccagataatgattttttctcattacctgacctctctcctagtctatcgcatttaagccacttccccagattacaactccacttttactgtcaagtgcagtaaatgtcatgacatatttcttcccatcttcatcccactgttttaaagcaatccctttatactctgcctcgtcggtctttatggtaatattataatctccacttaattcccaagttccctcaagagccccacttatcgtattgtttttattcaataccagttcttcagactctttcatatccggagagatatcacgtccgtggttaatatatttatacgttccaacaagctgtttactttccagtttttctgcactttcttcggtatagcggtatggcgcaataaccggccagccttcttcattaaaaaacatctggtgtacacgcacttcatgagtttctccgctattttcaaatcgtgtgtgataaataataaaatattttccggtttcttcctgatacagacaggaattatgacctggtgaaagatagccttttcgatcttctccttcttctccttctttccaggtaaatttataaccacccattaattttgttccgtactgttctgccgttgcatcactaaaggcacttcccgccggacctttacaatctttcatgtcctgtcccatggaatctacataaggaccattcgggttctcggaacgacacacacggatattatagcctccatctgaatctaagcctccaaacgataagaacatataataatatccggtttcttcattatagatgacataaggagcttcaattcttagatgatttcctccaagcagtttttctccatatccgctctctaaaggcattccgctctctgcatccatttcttttacaaagattcctccggaataagagccataaatcatccagagtttcccttctttatcataaaatacaaccgggtctaccacatttgggtctgttgtcgcctgatacagatttccatcttcgtccttctcacttgcactcattccggattttagcataattccctcattgctataaggtccttccacagaatctgaaactgctgttccaagacaggatagcggagagtcccctttgcaattacaataatataatttataacttccatcgtttaattttatgacgtctggagcccaaaacgtattgctctgtgaccactcaaatgcttctttcatttcttttaatacatttggaatcaccgtattattattttttactccctgattgacatacgtccagttcattaaatcctctgtttttgctactgcaagatgtgagccaaaaatataatagcttccatcttctccctctataatcgatgggtcatgaaccgatacttcagaaaattctttttccaccggagtatctgcttttaatttttctttttgtgcgccacaacctgtcattaacatgagagacattgcagcaaacacaattgctattttttttcgtttcataaattaaatccttctcctgtaaaaaaagcccaaatggatatcatctaccttctatccatttgagccttttcttatttttttgctatttccatcggactataggcaatccgaactttaatatcctgattataatttccaaattcacttccgaaaatggtaattccaccgatattttttgcatcttcttcaatttcaaatttaaatcttaccgtgcttttataatccagattaaattgattaattgtaacatctgagattttcaatccatctacaaacgttccctttttattaattacaatcatctttaacaatccatactggttccagtttggaaaccaccagtccggtgtaaagattccctgtacatctccatagtctcccggacttgtccaagtaccgatttttacatcattcaggaaaattgaaatatccgaaggccagtcattattaattcccggtgcctctgaactgatttcaagagaaaccgtaatctggtcaattttggttgcactcggcaacagatttggaatcatatactcaatatagccttttgtaaaccacaaaattccagcattgattctatccggatgagaaaaataacgtgggtcatctacctctccgacaattgccttacttgtagcaagtccacaggtcggatatacattataatccgaataatgtcctactttcacttccgtgttataaatattctggtcttcttcggtttcttcagattctacatcaaccacaatcttatcaactgcaactttacagattttctgatttccatgtcctccgcgttctgtcataacctgaatgattccactttcttccagctttttgatatgactggtcagcgcaccatttgtaattccaagacttgttgcaagttcattcatgttcatctcatggttttcctgaagaagcttgataatattaattctcagttctgaaccaagcgccttgaaaacctccaggccctcgtccaaatttttcacatgcaacatcttataagtcctactttctcagaaataaatacctcgtatcttcaaaatacctttagattggtctaaagtatactataccacgaattttccccaatacgcaagacctaagttgttgattccggtcagcacatacccttttttttgattttcaatatcacagcatgaataaataattccattctgaaaatattcactctctttatccagtgtacagacctttgactgtttcatattgttatcaaattcatcaaatataattaattcccagtcgccttggagcttttccatatccggtttcgataccggctcaaagttctctccctgatatggttctgcaccaaataccggccagtcattgataaaaaacatcggccgtatcatcatataatgaatctgatagctatccctgtcttctgcttcctcataaatacgatttacctttgcaccatcccgtacatgatgcacaaaataataatgttccgactgtgggtcataaaatgggacaccatgccccggtccacgaaatcctccccacttccagtctttttttgctttacccactcttggatttaccgcttcaaactgataactccctgcaagttttatccccattccttcttctacaagtgaatttccatgccagtccagatacggccctgtcacgcacctgcttcttccaacacggatgtcataagtatctccaagccagccataagactgaaacagataaaaataacctgtctcaggcgcataaatgaccgatgccccctccggtccgtcaatcaatgacttttttgcttttcttgagatacagttgccaagctccttcgcatcatttgagagagaaagaccacttgtggcatctaactctttgatataaattccaccaaagaaagaaccatacactagataacacctctcgttatcccagataatatgtgcatcaattgcatttggtgctgtatcatccgtcccccaggtatctgctacaattcctctgttttcaaacggtccaagcggatgtttagaaactgcaagccagattcttgattccgaactgccaaatgcttttgttgctgaataatacatccggtattctccatgtgtatattccacataaggagcccagaaattcacagtctgtggatactctccgttgtctcttccttctttgatggccttttgggaaagcgcaattccttcatattcaaaatgaatcaaatcttttgagcttctgaccggaattccgattttttctgtcagcccatcttccggctgatatacatccgtactataagagtagtatttttctgtcaccgggtcccacatcatagaagggtcatgggaccacagagatgcatttttaaaaacgctgccttcatttaatgttaatattcctgttttcaaaatttctcctctttttaaaaaagggctgttttcagaatatctgaagacaaccctatctctttttcttttcttatccttttacaccggatacagccatagattcaataatgtaacgctggaagaagaagaacaacaacagcgttggaagaatcgaaagcactgacgcagccataatcagaggataatcactgtttaccgcataatatgcattaaaggaacggatgacaacctgtaacgtaaaccattcttcattctgaataaagatggttggtgcaaggtaatcattccagattcccataaaccagagaatcaactgtgtcattaatgcacctttcatcaacggaaggaagatgctccagtacatgcggaagtaactacatccatcgagttttgcagcttctacgatagaatccggaatactggtcagattctgtcttaagaagaaaatgatgcttacatttccgaataatcccggaatgataagtggaagcagactatttgtccatcccatttttgtaaacattacatactgcggaatcataacaactgcaaatggaatcatcatcgttgcaagaagtcctaagaaaataccattttttcctttgaattttaatttactaaaggaaaatgctgcaagggaagaagtgaatgctcccactaccaacaccggtattgcaacagttaaggtatttcttaaacctcttaaaaattccggtttctgcaatacttcagagtattttccaaatttccaagggtccggaataatactaaagtttgcagaaagaatctggttctttgtcataaaagaacttaataccatgtacaaaagcgggaataccattgcaaccgctccgattaaaagcagtaaaaatataatgccatctatcgtttttgctttttttgtttttacttctgaactctgttcatctaattttgccatattcccacctccttactcgattgtcttaacccacttatcctgacccttaaagttaattgctgttacaataaagattaagatagcaagtataaatgccattgcagaaccgtatcccatctgattatttccaaaggatttatcatacatatagaatacaacggttgccgcactgtagtttaatccaccatttggaaccataacaagtacttctacaaatacctggaatcctccaatcaaaccggtaatcaacagatagaatgtaaccggtgataccagtggaagtgtaatgtgacggaataatctccagccgctggctccatcaatttttgctgcttcataatagtctcttggaatactctgtaaaccggacaggtaaaggacgatagaaccaccaagtcctttccataccatgaaaataatcatggatacttttacccagaactggtcacctaaccagtttggtccgtgtataccggataccgctttgataatactgtttaacagaccataatcatagttgaatacccacatccacagaattgcaactgcaactaaggaagatacaaccggtacatagtataaagtacgaagaatcttaattcctctcattttacgattcattccaactgcaatcaacatagccagtgccattccaatcggaataccaagcatgtaaacaatggtatttcctaataccttccagaattttgcatctgtcaataattttgcatagttctgaaatcctacaaaattatctaacatgctgttcataccattccattttgtcatactggcaatcagtgcaaacacaatcgggaatgccatgaaaatacagaaaccaatgaacggcggtgctacaaatgccagtccccagcaatgttctttatatgccgcacggttcattttttgctttgttttcgttttgctcatctcttccgctccttaatctttaaggaagcaaagccggaataatccggtcctgcttgaatttactattctacactctcccatgcttcatccagagatgcctgcatctgaggctgtacctgctcgatgtattcatctactgtcatagagccatttttcacgttatcaagtccttcaaggaaaatgtcgttccattcagcatttggagtataagttgtttcctggaatcttccctcgtatttgtctgttccctgtaaatagttaaagaatacatttacatttgatgggaatgcaagtgttccatcttcaattgctgtcataaattcaccgtcagcaaggtctttcatatttggcaactggatggactgcccaccttcgataccactaagctgtttctgtccggcatcatctgtacacagataagaaaccagttcagttgcttcttctttatttttactgtttgcagatacacagaaaccaactgttccaagccatgtcatggattttccggttgacagtgtcggatatgcacataaatcccagttgaatgggaatgtttctttatccataaatgctgctacgtcccaagtaccacatgcataaaatgcttcctgtcctgcaagccatctctgatatacaccaagagaagcatcctgttctacagtaggagtaattccaagttccagtgtacagtcaacatatttctgaagtgcttctttaaattccggagtgtcaatggttactgttttgtggtcgtcacttaagtagcttgctccgtttgaccatacaaatggctgaagcatgaatgcatttgcaaatccacatccccactggtcgatttctccatcaccatctgtatctttagtcagttttttacaaacttcgatgaactcatcgtatgtatatggattttccgggtccggataatcaagtcctgcttcatcaaataaatctttattgtatgcataagcaaatacggatgcatcttttggaagtgcatataaatcgccacttcctgtcttatctccatcatagcgatagctgtctaaagcttcctgtgctaacattccatctgtgctgattccttttttatccagaatcggctgaaggtcttcaatatatccgttctcaacaaactgttctactgattccggtccaacataaaagatatccggcaaatcccctgctgtcatcatacctgttaatgttttggaatattcgtcctgagttgtaatctgtacatcaatgtttccaattgtatctgcatggtctttcttatactggtcaatcatgcttttgtatacagttgattcatgatcatttgcaaagataaaaatagaaaggtttttctttccgtctgctgtttctgatgaatctttgcttccgccacatcctgctaaaagtgatgtagccattactgctaccagtcctgctgaaactaatttctttaacttcattaagggctcctcctctttcttcgatagactatatcgtacttcgtttctaaagccatactagcacttaattttagatttagcaatagttttttatatttttctaaatattcacatggttttcgcttttttctacaattctgtcattttgtttttgtgcatatttttctaaaatatttagattaggctaaactatatttcttatgcaaatacctcttccattgtctgatattcaaacaccgggaaatcattttcgtcatagcgcactttcattatcatcgcatgacgatttgggtcataaagcgggtctcccacaatctcatcataaggtcttgcatgataaacacaaaggtctgtctctccatcttccgcttttacaaatgaattgtgtcccggtccaaacacaccggcttttacatctgttttcagtaccggatagcgcagttttgtccagcacgctgggtctaacaggtctgcatcctcatcgatagaaagcatacccatgcagtaacattctccggttgcacttgctgagaaagtcatataaatttttccgttatgttttaaaattgccggtccttcatttacccagaaatcaattctttcccagtcataatccggtgttgttaaaagtacctgaacggttgcaagcttgtttggtgtttccatttttgcaatgtacaggtttgaaatctgtttgccaacccctgttttttctgcccagatatagtaataatcccctttatgttcaaatactgtcgcatccagtgaaaatgcatggaaagaaaattcatcttcatttgctgcctgcatcattcctaattcttcccattcatctttcatcgggtcttgtcctttacaatgaagaacgtaaggacgaatttcccagatgtcatctttatcccctgctgcgtagtaaatgtaccatccaccgtctacataatggatttccggagcccaaatatgaatactctgtggtccttcttcatgctttacccaaagtgttttctctttggcctctgcaagtccttttactgtatcggaagaacgaagcacaatcttatcatattccggtacggaagcagtaaaataataagttccatcctgactcttatacacatacggatccgccctctgtaaaatcaatggtttgttgtacttggtttctttatagttatttttgttcattcctttttctccttttagattaatgtaaattaattttatattatttaaatataaatttcaatagtattttagacttttgtaaaatattactgattccaattcggcttttttgtgaatgattttgcggctttttgtttgaattttatattagattattctataatattatacggaaaccaaaacatttaagattttaccgccaaaaatggcagaacggagacgatttttttatgaatctttttacccatgacagcttgctgtctcgatttttctatcttgtaggagatatcatcacccttcattttttatggattttatgcagtcttccaattatcaccattggagcttccactactgctctttattacagttgtatgaaacgtatccgtacgaaagaaggatacccgcttaaaaactttttttcttcttttaaaataaattttaagcaatccacacttatctggattgggctaatgattatcggatttgtattttttacagactttcgaattgccatggcacttgaaaatacactcggtcgtctgatgctggtgacctgttcctgttttcttattccataccttctcatttgcctttatatttttccggtacaggcaaaatttaaaaataccatctacaataatttaaaaaatgctttttttatggccatccgtcattttccattgactctgcttttaattgcaatcgatgccacttttattctgcttttcttttctttcgttccatttattggactggcactttgctgtggagtcggattgcttggatatttaaatgcgaatttatttgtttttatctttcgtaaatatgtacccgatgaattagaacacgacctagaaatctccggtgaacgattttaagaggagccctttttatgaatacaaaattcaaaaagactgctttagaagatgatgcagagatttatcagcacggcacaaaatcagccacaaaagacgatatcaaaaaattgccgcccaaaaaacgtatcgcttacttttgtgactactatctggcaaaatgtcttgtggtccttgcccttatcatctgcatcatccttattatatgcgcaagtatcaatggaaaacaacatacccccgtactttctgtcgcactcatcaatgaagtctacctttcggatacggatgccctttgtgatgagataaaagaaagtcttgaactagatgaagatgccatcgtaaacgtcacttattacaatctcaacgaatatcaaaataacatgtcttatctggctcatctttctgccggaagcgtcgatgtgattctttgctctgaagaattttttactgattctgctccacagggaatgtttgcagatttaagtaccctgctttcaaaagaggaactttctgcttattcctcgcagttaaaagaggcttctattgttgataccgacacagacggaaaaatcatttctaaatctgaacctgctcctatggggattgatgcaggaaattatattatctgtctaactgaaaaaggggacaacccagaaaatgcgaaaaaagcagtttctttctttacgacacacacagactgcctgaacccataaattcaggtagtttgtgtgttttatttttgaaatagacttttccctttataaaatttctggtatggttaaataatatcaattacaatattcctgcttatttcaattaaataaactggccgaagtaaaaggcatgccttctgttaccttaaaacaacgataacgcccgttttaacgatgcattaaatccagaaaaactcgaaggaagctataccttaaatggagagcttaataccagtgttaccagtcctatcgcagatgctgccaatcagttaggaaatggcggtctttctagcgcagacgaagcattaaatttatcaaaaagagataacataaaaaagggacggagtttgtagcttgactaagccacaaaccccgtccctttttagattattctctgtcacgccttctgcttaggtacaaactcaattttgagagccattcccataccatctgctaaccgtttcagtaaattaatagaaggatttctagttccattctcaagcttactaatatctgcctgattaatacccgtacgctcagcaagctccttctgtgtaagattctgagaagttcttgcatctacaatcgctctgataacatccatttctggttgaattgcttcatattcttttttaaattcttcattttctaactgcttagagagcatatcatcaaatgtcctcatctctcatcatcctttctatgaaatcttttctcctgtcttttgcaatctgtatctcctcttttggagttttttgtgtcttttttacaaaaccatttgtcattataattttttcctcacaataaaaaaatacaaaactctggtaatatcacttagaagtattttctaatctctaagaggttttctacgcatccatataagatttcttttaatgcttcttctggttctgtctggtccggaaccatcacaactttacaccctgcacgataggcacttaagactccatttggcgaatcttccactgccatacattcttctggcaaaagtttaagctgcctacaggcatattcataaatatcaggcgatggctttccgtattctaccattgttgcacagataattttatcaaaatatggttctaaaccaatttgttttaagtattttctggcacgttcttcatccgttgccgtagcaatcgcacgtttgacattttttgtttttaaaaattcaagcagttctactgctccttttttcagttcaattccattcttttgaagacattcttccatgatttcttttcgataattacgaattgtagtgtaatccagattctcatcatgaaacatctcttttaaatgttttggcgcatagggtcttccaagagagcgcatactaagtgcctgttcatcactcatctcatatccaaaatgtgccagtgcctttggccagaaaatccggtaatatttctctgtgtcaattaatgttccatccatatcaaaaatgactgcttttatcatactgattttttcattccttctctttttattcttctgttttattcttctgccttcgcatcaacccactctacggtatattcttttccgatttgttctcctacatttttcacatatccttcaatcaggcttttcgcccgttcttttgcctgatttaaaagatttccattctcatttgcagtttcttccatgtgattttgcgcctctgcaagtgcctcggtttcttcttcttttgtgattttagtcataaatccggtatcggtaagaggctctcccatagaatcctcgtctaaatccacactcaaaatctcagcatccggaatggtcacctttaccacgccgtctttgcttggtttggaaacagacaccttgctgacatctaccccaagttctacaattccactgtactcagtccagatttttttatatcctgttccaagccatttaaacaatccgctggcttccgtctctgattttgctacattgtgataatagcattttaaagttgcaagttcacagacggattgaattgctgaaaaatcagcctcttttttttcctctttcttatctgcacacccggtaagacacagcatactgattactaaaagacaaagtattttttttcgtttcattttattttctccattttttatcacactttaccactgaatcgaatacccttcatgttcaagaatcggtgatagcaatgcttcgattacagattccagattttcctgggctgtttcatataatttatctgaatgatttgcctcattcattgcatcttctttacaaagcgtaatgacttcttttaaagaaaggtctggattctttggaatatagctaatcgaattttcatctagcgttgcaatattaatctctatctttggaagaaccggtgtcacagtctttttttcttcattgattttaaatgtcacctcttccatgttaattccgactttcacattggcatcatacgcaatatagcagtctatctcatccggattttcttgattatgtttttctgctacaccgttataaacaaactctgcggtagaaagctggctgatatttatcgcatcttcgagttgagaagatgtaatggtcgtttcttttcctgccttgttcatcacgcccggaagtaccagacctgctcctgctgcaattgccacaatcagaacaagtaagacaagttttttcttcatagtattctcccataattttaaagttttctggtttcctgctattttatcatattttattaaatctggaaatacaatgaaaatgcacaaatgttcttgcaagtcgaatatattttctatataatgatgtttgttgtgactttagatttacaaaggagagaaacatgaacgaaaataaagagttcaagccgtatattccggctgaaaaagtgacacctgaatttacaatcacttctattgtaatgggtatccttcttgcaattgtgttcggtgcagcaaacgcttacctcggattacgtgttggtatgaccgtttctgcatccatcccggctgctgtaatttccatgggtgtaattcgcgttatcatgcgaaaaaactccattttggaaagtaacctggtacagactattggctctgccggagagtctttagccgctggtgctatttttaccctgcctgctttattcttatgggcagcagaaggaaaaatggataaaccaagtattattgaaatcacaattatcgctttaatcggtggtctgcttggtgtgttattcatgattccgcttagaaacgcattaatcgtaaaagaacatggcgtacttccttatccggaaggtactgcgtgtgcagaggtccttttagctggtgaagaaggtggagcaaatgcttctactgtatttgccgggcttggtattgctgccggatttaaattcattatcgatggattaaaactggttccaagtgaagtatctttccgagtaaaaggatatgctggagaaatcggaacacagatttacccggctgttatgagcgttggttacatctgtggaccaagaatttcttcttatatgtttgccggtggtattgtcagctggctggtatttattccagcaattgtactgtttggtaatgatttgactttatatccgggaactgctcctatcggagaaatgtttgcagccggaggcgcaagcgcaatctggggaagttatatccgctacatcggtgccggtgcactggcagcaggcggtatcatcagtttaattaaatcccttcctctgattatccgtacgttccgtgatgcacttaagagcatgtccggggcaaaaggtacaagtaacaaacgtaccgaacaggatttaagcatgaaattcttattgcttgcaatccttgttctgactctgcttgtatggttagtacctgcaattccggtaacgctcgttggtgcgattatcgttgttatctttggtttcttctttgcaactgtttcttcaagaatggttggtcttgtaggaagctcaaataaccctgtttccggtatggcaatcgcaactcttctgattgctactatcatcttaaaaataacaggtgaccagggtgcccatggtatgcagggtgctatcgctatcggttctattatttgtattgtagctgctatcgccggagatgcttctcaggatttaaaaaccggatatttactcggtgcaactcctaagaaacagcagattggtgaaatgattggtgttatcgctgctgcttttgcaatcggtggtgtattatatttattagatgctgcatggggctttggtactgaacagctcggggcacctcaggcaatgttaatgaaaatgatcatcgaaggcgttatggatggaaatcttccatggactcttgtattcattggtgtattcctcgcaatcgcagtagaaatcgtaggaattccggtacttccatttgcaatcggtgtttaccttccggtacagctcaatgcttgtatcatggtaggtggtcttgttcgtcttgtatttgataaaatgaacaaagagcagaaagaaaaagatgcaatcatcagcgacggtatcttatattgttccggtatgattgccggagaaggcttagttggtattttactcgctatctttgctgtatttggactgaatgatgcaatcgacttatcttctaaattaaatctttctacaccggtagctaatatcggaagcttagttgtatttgctctgattatattaagtttattgaaattttccgtctggaaaaaaagaaagtaaatgatgaaaaaaaataacaatgtgatttcagagaattatctggaacgaaaaccaagccgaccggagggcatctcctggtcggctgatgaaaatggaattattacactcgacattgaaaataccggtgcttttaaccgaattgcgcaaaaattttttaaaaaaccaaaagtcacacatatccatctggatgaaatgggaagctttgtatggcctttattagatggagaaaaaaatattatcgaacttggaaaagaagtcgaaaaacatttcggtgaaaaagcaaatccattatatgaacgccttgccaagtattttcaaatattagatagttatcactttgttgagtggaagtaaaaaatagctcttatcatgaaattgaattttcacgataggagctatttttatttacttttattatttactttttctttttgacacaattatcatctgagcttataatatctgtagatttttttaatccaactttaacgaaaggacaccttttatttatgtttcaatgccaatccggatacacccttcgcaaaataaaagacacctgctatttactgccttatggtcagcaaatcgcagatcaacgaaaaggcatggttttgaatgaaaccggaaccttactctggaatcttctgcaacacaatgaaggcatggaatttgacgaccttgtaagtgcgattgccagaatttatcatttagactccgattcaattccaatgctttgtgacgatgtgcgtgactttcttacacaacttcaagcaaacggaatccttgtagaggatctccagccagtttccaatttcactacaatttacttagaaattgccggactcaaactgcagatttatgacccaaagcagcttctcttagagcaatcggcactcacgcattttgactcttttggttttgaaccggattcttccccaaatgccaaagctgaccagcgctttgaactgcttacaattcctccggcaagccacgcttatggagaagtactgcttcaaaactcagaactgagcgtatttgaacacgccaatcattacatcatcgtctttcatcctatgcaaaatttatatgaagcgcatatgaccaaggacggaagttatgtccgaatttattgcaaaccggaacactccgatactgccactgaaaatttatttcatgctatccgtttattttttctttttattgctcaaaaaaacggattatttgcgattcattctgcctctcttttgtatcatcaaaaagcatggctgttctctggtcattccggagttggaaaatctacacatactgctttttggaacacactttttcaaactccatatttaaatggcgacttaaatcttttaggttttgatatcaaaaaaaagcagattatggtttatggaattccctggtgtggaacttccgggattttcactgcacaaaattatgaacttggtggaattgttcttctcgggcagcatccatctaaaaatcattttgaagatttaaatgaatcagaacagattcttcgggtgatgcagagaatgatttctccggtctggaaagaacaacagctttctttgaatttgatgtttgctgaagaaattgtttcccatgtgcctgtattttcttttctatgtatgccagagccttcttctgcacaaagcttaaaagcaggaattaacctttgggaggataaccatttgacatgaaagaaaaaatttctcttatatggaaacacttcaagcagggttctttacaaaaaatatggcttcagaccttatggatttatcaatacggaaaacattattggaaatctatgcttatctatactttacttgggcttaccggaaccgtggtttccctcatctccagtctgatctccaaggatttggtagatattattaccggtcatcaaaccggaaaattagtaagcacctttattgcaatgattagcttttctatcatcagcattctgatttctcaggcttccagctacgcatctaccttcattaatctaaaagtagatactgagattaaaaatgacattttctccaaaatgctcgttacagactgggaagctttgaccaaatatcataccggagatctggtaactcgctggagtgccgatgcttcaaatatttcaagtggagttttaaactggattccaaatctgatcatctacgtctttcgttttctcagtgcactggctattgtgctttactatgatccgacttttgcactgtttgctttgattggaattccatttagtgccctgctttcgcgaccgttattaaaacgaatgaaacaaaacaaccagcgcagtgccgcaatgaatgccaaactctatggctttaaccaggaaagtttttcaaacattcaaacaattaaggcctttgacttgattcatttttataccaataaattaaaatcactgcaacaggattatatttccatgcgcctggattttcagaaaatgtccatgctgacttctatcttaatgtctatcatcggatttattgtatcttatagttgctatggttggggaatttatcgtgtgtggagtcaggcaatcagttatggaacaatgaccatgtttttatcgctctccagcaccttaacggcttctgtaaattcattggttggcttaattccctctgcaatctctttgactatctctgccggtcgtcttatggatatcgtagagatgccacaagaagaccatagccaagacactctggtaactgagtttgaagcgcagcacaaattggaaggcatcggacttgaactaaaagaattaaactacgcttatcataccggtacagaagttttcttgaatgccaatttaaacgcttacccacatgaaatcatagcgttagtcggtccttccggagaaggaaagacgaccatgctccgattgctgctctctctgcttaagccacaaaacggagacctttcggtatgttccggagcaaattttagtaaaaaaatttcattgtctccttccactcggaaattattttcctatgtgccacaaggaaatactatgttttccggtaccattgctgaaaatatgcggattgtaaaaccggaagctaccgatgcagaaatcatagaagcgctaaaacttgcctgtgcctgggaatttgttgcgaaattgccggatggaatccaaagtgagataaaagaacgaggcggtggactttcagaaggccaggcacagcgtctttcgatcgcacgcgcattacttcgaaaatctccgattttgcttttagatgaggcaacttctgcacttgacgttgccaccgagcgaaatgtattaaaaaatatcatgcaggatacttatcccagaacctgtattgtcacgacacatagaccaacggtattaaatatctgtaccagggtttatgcaattcgggagaaaaaatgtgagtgcttagccgaatcagaaattcaaaaactgatagccgaattttaaaaaaacctctgccgctgtgaacaacatagcgacagaggtttttttattaatttattagtttacagaataagtaaagctttccatcttaagatcatcaatgctggttccatgatcaatatgaattccaattgtaagtggatttgatgcagtacttgcaaaagttaaagtagcggtacttccattccatgcgcactgtactgatgcatcgtctgtctcaacctgatctacggtatcattaaacttaatgtttaaagtgatggttccatcaattccggaccagtctgccatagccaaactttttccgccatttgtaccccatctgtcccatactccataataagttacatttaatgtgccctgtgttgctccacttgctgcataaatcccttctgccattccactgtccactgtaattaccggcttttcgtatgctctcatttgtatctcctcctttaaaactatacttactaagttaagatttgtttttttattatcatattcatatattatccaaaagtcaagaattttttaataagatttattgtactttgtgactgtcaatgctataattacaaaaataattgtaccttatttagacaggagaaattatggaacctaaaattgatctcgaaaaattactaaatgacggtgctatcatccgcatcaagcctcagggctatagcatgtatcctttatttattcccggtcgtgatgaagcgctgattcaacaagtcccgattggatatttgcagcgaaatgatgtcgtgctctatcgcagagcacatagcattcttgttctgcaccgaatttatgctgtcactcctgctggtttttttatggttggagacaatcaatctgagcttgaaggtccaattcagccggaacagatcaagggaaagctgattgcttttattcataatggaaaagaaatctctgttgacaatattctttatcaaatcctttcttttttatggctctggctgcttccaatccgcccgttttgcttcaaattaagcgcttttttgcgaaagctaaagcagaatctctttcgcttttaacagctgcacgactgcttctacatcttcgtagacttcatccggcgttactttatactcttttgccactaacagagccagttgctctatggtctctgcttcttcggcatgctcatagataaaaccagcggtttcactaagtgaaaggacttcatgcactgcttctgtcttttctccgacaggcagaagaatccattcatcttccagttgcttcatcagatatccatttgattttttcatatcaggtttccttttcttagatttatgctataacatttttatttcaggagtttatttttatgaaacaagtataccatacctatttaagtattatcaaaaaaaattgcaccgactccgagtgcaagattgtagttccaaaagaagaatattctcaattaatagaattggcaaagaaacagtgtacgcttccgtttctcttgccttactttcgtgatacgccttattttctgttcttgaaacaacagacgaaacagattttactaaactattatgagctggaacattttaccagaaaaacggtttcattactttcacaaaatcagatttcctgctatctcttaaaaggtctaagccttgccgcttattatccggttccggagtatcgcaaatcaggggatgtggatttatatatcaatgattccgaaacctttgagaaagcgaaatctctgctgatttctcacggatatgtcttacaagatgaactcagtgaccaccatatgctttttttatacacgtttccaaagaccgggcgccaatttgaactggaactgcattatcgcattgtcgggttatatcaatatgaacaagccaaccaaatcgtggaggaagtattttccaatccacctaagctgacacaaacactctatggatactcctatacggtgcttgccccgactgaatctgcattttatctgattcatcacatgttaaagcactatctgtacagtggtttcggaatccggctgctctgtgattttaccgtttatttaaaccatttttataatgaaattgattttgagaaactgcatgcctggtgccgagaatccagaatttttcatctttatgaaatcattttagcgtgttgtcaaaattatctcggacttgcagagcaaattgatccggaagttacttatgatactgacgcctgcgaacactttctttcgatgattttagaaggaggagatatgggtacgaatgcgaatcatgcgattgtcggatccacctcttatcaaaaaataaattggttgacgtattttaaagaaggccatctgcaaatgaaagtacgctttccaaatgcctcccatctccctgttttatggccatttttatggttctggacctttgtctgctttcttaaaaataatcgaaaacttcgaaacacaacatttcgggcagtccttcgagagtttaaagaaaaaaatgaacacaccaggcttatccgtatctttgaaaacagcgactcttaataatgagccgctgttttattcttttattttatcctccacaactttgtagccttcaccgattttatttacaatcggatcatatccaagtactgcttttagtttctttcgaagtgatgacatatgaactcgaattgaaccactaaaactatccgcagacgcatcccagacatgttcaattaattcctcctgactaaccggtctgccttgattcaaaagcaggtattctaagattccattttcttttcgggtcagcgccacaaattcgccattggcataggcttcccgcttttttgtatcgaactttatgcctccgcaagtcaggcacacatctttttgcacaaacttacggcgggtcaggcttcggatacgagcctctaattcttgtaaatgaaatggcttttccatatagtcatttgcaccggcatccagcccttcaactttatctgctatctgacttcttgccgataaaatcagaacctttgtttcctcattttttttgcgtaattcttttaaaagctccattccatccatccccggcaaattcaggtcgagcacaatcaaatcatagttttctgccaatatataatccagtgcttcgctgccgtcataacaggtatcgacttcatagccgacgtgatacaaagttttggcaaccgtatcacataactctttttcatcttcaacaattaataatctcacggtattttccccatttccttaacagaaattttacaccctctattgtataatacttatgtcgacaggtcaacaaagacaaatttggtcaaaagaaaggagcaatcaatttttgaagagcaaacaaatactacaacttatcttacttgctgccggtattattctggtgacgtatgggatatccagaggagaagcggctgttgtacttagcaaagcaattaaattatgtctggagtgtgtaggaattggataagaaaacaaaactcaaatcaaagaaaatcgcaggcttgcgtggttggattcaggcggtcgccaccttgcttacaaatatacatattcctaatttatttaagggaaaaatctatcagggggctgccaaaaatgtctgtgtaccgggactaaattgctattcgtgtccggcagctaccggagcctgtccaatcggagctgtgcaggcagtgattggttcctcaaaatttaaatttacttattacatcaccggattttttattttgctgggtgtactgcttggaagatttatctgtggattcttgtgcccgtttggatggtttcaggatttacttcataaaatcccgtgcaaaaagttttctaccgcaaagcttaagccattaagatatctgaaatatttcatcttaatcgtgtttgtcatcctgcttccgatgcttgtgacaaattcaattggaatgggcgatccgttcttttgtaaatatctttgtccgcaaggcgtgttggaaggtgccattccattagcaatcggaaacacagcaattcgctcggcacttggcagcttgtttcgatttaagagtattatcttaattacggtggttgtcttaagcattttattttaccggccattttgtaaatggatttgcccactgggtgcaatttattctttatttaataaagtatccttgcttagcataaaagtaaaagaggatcaatgtattggttgccataagtgtactactgcatgtaaaatggatgtggatgtgctaaaaaatccaaatcatccagagtgtatccggtgtggcgcctgcatgaaagcatgtccaaaagatgccatttgctttcaatttatgaaaaaccaaaaataaaacatatatctataaaggagagtttaaccatgaaaacaagaaaaaatattattaccattctcacactttgcgcagccttatcactgactgcatgcagcggaaaagacactactgaaaagaatcctaagaagaacgaaagtactacctccgatacaaaagagtcaacggatgcttccactaaaaaattagatgatctctatcagcaggaaaatcagatttttgcggatcatagcgaagtatgggataaagtatttggcatgatgagcaagacaaatacagattccgatagtgcctatgcagatttccttaccgcaaccattgaagaaaataaatcttcttttacagaggatgaactcaagacattagagagcgacattgaaaccattcgaggaattgaagaacagatttccaagctggaagatgaactggcaacaaccggctctgcggatacagaagatgctgctgatgaggatactccatttaaagatctttccggaacagacttcgacggaaataaagtggatggaactctgttttccaacaatgccgtaaccgttttaaatttctggtttacaggctgtaaaccttgtgttgcagaattatccaaactcaatgaaatgaatgaagcaatcaaatctatgggcggagaagtcgtaggaatcaacactgaaactttcgattcaaatgaatctgcaattgaagatgccaaaaaagtgctggaaagccagggcgcaacttaccgtaacctttctattgcatctgattccaatgcaggaaaatatgcttccgaaattatggcatttcctaccacgattcttgtagatcgaaacggaaagattgtaggcgatccaatgcttggcggaatcgatgatccggataattatgatacgcttatgagccagattcaatccgtgattgatgcagacagtgcaaataagtaagtaaaaaatcatgaaaaaattatcaatccaatggcgacttacaatcatcactacattattcattgcattaatctgcggatgccttacgttatttatctataaaagcggagtttactacattgattctctgcaagatacggtaaatgcccaaaatgaagacgacagcaaagacggctcggaggaaatctatatcagcatcccagatgaaaaatggcaagattttgcaaatgatttttccattcaagtttacaataacaaagcagattataggaaaacaagtctgattctttccgcactgatggcgcttttgggcggtattattaccttttttataagcggacatgcgctaaagcccctcagtgaattttcggataaaatcgaaaaagtacaggcacaaaacctggcagcttcacgaattgaggaaaacaaagtcaaagaactcaatcaactgagtatttcctataataagatgcttgaacgactctctgagtcctttgaaacccaacgccaatttaccgcaaatgccgcgcatgagcttcgtactcccctggctgtcatgcaggtacaacttgatttgtataacgctaccgaacatccggataatgatgagtgttctcaaaaaacgctcaaaatggtgaccgaacaaaatgaacgactcagcaaaatggtaaaaacccttctggatatgagtgaactgcagaccgtggcacgcaacgaagaaattgcactcgatgcactcgtcgaagaagtcctcgcagatttagagccgcttgcccagaagaaaggcatcacccttaccggaaactgtgaagcccttactatgacaggcagcgacatcttaatctaccgacttgtttataatcttgtagaaaatgcgataaaatacaatcgctcggatggtcaagttaccgtaaccgtagcaaaaaaagaccaaaacatcattttatcggttgcggataccggaaatgggattcctgaagcactcaaagacaaaatctttgaaccgttctttcgcattgataaatcccgaagccgtgcacttggcggtgtcggacttggtcttgcacttgtgtatgaaattgtaagagtccataatagcaatattactgtcaaagacaatcctgcgggtggtacaatttttgaaattgttttttaaacatgcaaatttttttgcatctcttctttaaactctctgcctttaaacaacagcacgcctactaaaaataaaaagcacgccaatgcaccaaacatactcacagttgggcgcttcaccactttgcaaaaaagcaggatgcccggaataatcagcccgtatccggcagccataatttcatagatcagatactctcttaccgggcttttctgcactcttgcaatcacacacattgcaagcagaattcctacactcatcagcggcagcacaaaatcgaccgaccagctatgccatccggttaatgcatcccagataaagctaatgatggttccgattaacagctgccacatcaaattttttaataaattgtagcgtttaaagaagccaattgacgaggcaatccacattgttgcaacgcctccggcggtaaacagtgtccaacgaatcttcggatggaaatttaagtcggtcaccaacatcaatgccactagtgcaatacataaaaaactataaattttatagactttcatctcctgctcacttggcatcgttggcttcggaaagaccggctctactttttgggctgaaattccctgctcttttaataagcgataaaaattgcgttcaatattttcggtatcatatctggaggtaaatgcaaaggacaatttatcttgaaatgaacacagacataattccattttcggagtgtttgtatacacaccaaatcgctcaatataaggcacatagcttttgggcattttaaccgcactcatattagaaaaaattgcggttacatttttttctgaaaattttgctcctgcctgaatacagagattcttaagttccagcggtgcgagccgcaaaatcgggtgtagttctaatgcaagtaattcactgatatgtgccgacattttttctttggtcaactcagcttcaaaaaaggctttcgtgtgattcaatactgcttcaaagcttccatcttgcgttgcaaaatcatatcccggttcaatccagttaaagaaatttaacatcgacgtcgatggaaaaaattttcttaaatttaccggtaccattaatatcacagaacgttttttctgcatcttcgacatttcttcgtgaatagccatcatatagattgccgtcaaaaagatggtcatagaaacaccaagctccctgcttctttttaagattgcctgtaccgaaacaatagattcatggacatgcagacggtttccatctttcttttttctacgtatctgaaatgcatgcagcttcctttttttcggtcgtttttggtcttttgaataatatttcaggaaactatcatcttcctgatcctgcactgtcatatcttccggctgcagggaaacctgctccagtccctcttctttatgcgcaagatacagatagtttttcaccaattcttttaaaaattcagttgctccggtgccatcggtcagtacatgaaacacttcaaaattaatgcgtttttgataatacgtcacttcaaacagcagggtctttttgtctctgatataaagcctgctgcaaggctctttatactcttcttttacaaccggacgtaaattacaaggctcaagataatgccaaaacagaccttttcgaagtaccataagaaaagtcggaaaagtttctaatgtctgatccagcgcttcttgcaaaagctcagactgcacttgctcttttaattcacaataaaatcgaaagactcttgtatcttttttattactggccgcagaatataattttgctgcattatccagttttctccaatgtgcttttttttgcttcacgatgcttcccctttcaaaaattcattgatgtaggtgaaactttcctgcacatgcagctgcttgattcccaatgcgaaatagccgtgaagggcatctttaatccgatgaatctgtacccggttgcccgcttcttttaagcgttttccatacgcttctccctcatcccgaagtggatcaaattctgaggtaagaatcaatgtatccggctgattacttaaatcttttgccagatatggtgcaaaatatgggttctttttatcttcctcatttctcgcatagaggtcaatataatcctgcatttttcctgctgtcaaaagataatccgttccattttcttttacagaggcaaatggcgatttttcggtataatcgttatacgtagcaggataaattaaaatttgtctgctcggcataaactcttttcggtctcttgccatcaaagataatgcagcgcaaaggtttccgcctgcgctgtctccaatcagtgtaatgttttccggctttacatttaatacaaactgaccggaatataacgcctttgcaactgcataacaatcctccagccctgccggaaatttatcttccggtgccaatctgtattctacagaaacaacatactgtccggttgcatctgcaagtcgtgcacagattctttcatagttgtcaatactctctgtcacccagccaccgccatgtataaataaaagcagctttcgctcttgactgtccgcttttttttcttcactttcccgaaaacttttttcatttggaaagaaaatacgaaccggtactgcatggctcccgttatatattttttcatctacttttttataaaaaattttcattggatccaatcgctttaaatccgccatatgacgaaacatttctacttctacaccatcaaaagaaagtgcttttaaaattttctttgccgcttgattgatcaatattttttactcctttttatgcataaattttatattgattaagttttagtatagcacaaagcgccatgaatgctctagggtttttcctctttctaacttttaattatttggatgcactcaaaacactacttccgtatctctggcatacgcatttgaaacaatctccattggcactctctccagccaatcttcgccccactcttcacgcttttccaacacaatcatccgtcctgtttccgtaagcactctggctaagcgatcttccgatgctgttagtgacggtttatttcctgaataataacccgccgttgaactaggtgtctttccatacttttctgcaaaacaagagacttcctttgcagttaccattcctccggctctgtaaatttcttcaagtactgccactcttcttatctctgcaagtgtcgcagttactgtgttatgttcagcttcaagccgcgcaattattgcagatagctttgcctgcatttcttttaattcgtcgagtaaactttgcatgattttcgtttcctttcgtatttcatccttcaaaccgttctttcatactttatatgaataccctatcacagctcgactgctttgtcaattcattgttttattcattctttggttatcataatgaatttttgcaaaaaaacagtttgcgttaacagaaaacactcctgttaaaacaaactgtttttaaaagtgctgcaacgaccaatagagcgaatcacttcattctactcttcatcattttgttttttacaggttccttccatctttgcaatttcttctgtggtatattcctctacttttgtctttgttactgattttatatgttgctttttcaatctcgaatatacaaattcgcggaaaatcgtatacaatacagataccaaaggaataaacacaagcattcctacaattcccataagatttccaccaattgtaactgctgcaagtacccagattgatggaagtcctacagacccacccacaacatgtggataaatcagattgccttcaatttgctgtaaaacaagaaatacaacaataaacaaaattgcctgtttgggactcaccataaaaatcaaaaaacatcccattacgcacccgataaatgccccaaaaacagggattaatgcagtaaatgcaattaagactccaattaaaagtgcatatggcattttcaaaatacttaatgtaatgacaaacatacttccgagaatcacagcttccacacactgtccagtaaggaaattggcaaatgtgcgataagtcagggaacaaatatcaagaaacatcgtcgctttttgtttcggaataaaagcgaaaaaaatctttcttatctgtacatgtaatttctctttttgaaaaagaatataacaggcaaaagaaaaggcaataaagaaagttgcaaatccactaacaagggagcctactgctgacattgtcgtattcatcatattgcctgctccgtttccaagaacgctgattccccacttaattgctttatcagaatcaaattgcacctgatttaccaggctcataatttcctgattatcattggaaaactttcgaatccactcttgcatctgcggaataaaatcagcaatacttgccattaagtttcccattgttcgcgtaagttgcggaattacaccaaacaacactaacagaatcacactaagcactaatataatggtaagcagcagactgactggtcttgcaaactttccccctgcctgttttcctgcttctgctttcccaaaaattttctgttctaaaaaactcattggtacattgatcacaaatgcaatcgctccaccaagagcaaaggggaatacaattccccatagctcttttattacgtggattactacatcgaacttccataatgcaacaacaagaagtacagtaaatgcaatcaattcccgaatttttttaatattcattttatttaaatccattattattctccattttttcttaattttatgcgtacccatttaagaaattgaataatcggaaggctgacaaacgcatacagatataccaaaccaagttgaatccaattcaaagtttctactttaaatattatatgaagttccggaatcatcaatactgcagtaataagtgctgcaccaagtaaaaatgctccctgaagccatttattattaaaacagcgttttgtaaagagaaccggatgatctgatttacagttaaatccatggaacaaacgtgccaggcagagtgttccaaacgcatatgtacttccgagtaacgcaccgttttgatgatagcctgtcaaaaatccaatcatcgtcattgcaccaattaccaaaccttccagaccgactttaccaagaaaatcttttgtcagtattgactcatctgcggatcttggtttttcattcatcacttcttggttatgtggttccattcctaatgcgattgccggaagactatccgtcaaaagattaataaacaatagatgcaccggtgcaaatggaaccggaagccctgccagtgatgcacaaagcaccgttaaaattgctccgaagttacctgataaaagaaattgaatcgcagacttgatgtttcgatataaatttcgtccattctccactgcttttacaattgttgcaaagttatcatctgtaagcaccattgccgctgcatctttggcaacttctgttccggttactcccatcgcaacaccaatatttgcctgtttcaatgccggagcatcatttacaccatctcctgtcatcgccacaatcattcctttttcctgccatgcacgaacaatgcgaattttatgttccggtgatactcttgcatatacagaaatattcggaacaaactctcttaactgctcatcactcatattttcaatctctgcaccttcacaagcttccgataaatcatgcaatattccaattctttttgcgattgctgccgccgttattttatgatctcctgtaatcataaccggacggattcctgcttttatgcactcttcaactgccgcttttgattcctctctcggcggatccatcatagcaattaatccaagaaatactaaatgattttcatcttctatcgttagtttatgctggtcaggaatttcacgataggtaaatgccaacactcgtaatccttccatcgaaaactcctggttttgttgccggattttttctttttcttcttccgtaagttctcgaaccccagcttttgtccaaattcgttctgttcgttctaaaagccgatcaacggctccttttacaatcattcgattttcaccgtcaatttgatgcaaggttgacatcattttacgctcactatcaaatggaagttctccttttcttggataaagtgttcttacacttgcagcttcaaccccatatcgacttcctaaattaattaacgcagtttctgtaggatctccgatttccaccccattttcatttgttgaatcattacataaaatactatcgtccaaaagtcgtctttgagccaggtctgttatatcaattttacttgctgaaatccgttttccatctatataataatcttccacagtcattttattctgagttagtgttccggttttgtccgaacagataatagaaacacttccaagaccttccactgcctgaagtttacgaataattgcatgctcttttgccattttttgtgttccaaaagaaagcacaattgtcacaatcgaactcaacgcttccggaatcgccgcaactgcaagcgccactgcaaacataaacgcactgctgatttcttcaccacgaaatacgctgactgcaaatagaattccacaaaatattaaaattaaaatagaaagtttttttccaaatttttctaaactcatctgaagaggagtttgtttttccgaagtggatttcaaaagccccgcaatctttccgacttcagtctgcattcctatctcagtaacaactgcttttcctcgcccatatgttacaaagctaccggaaaataacatatttgttcgatcgccaagtgatgctttctccaaaatagtatccatacttttttcaactgcaaggctttctccggtaagcgcactttcatcaaccttaaggcttgcattctcaattaatcttccatctgcaggaaccatatctcctgcctcaagtaaaattacatctcctacaactaactctcttgccggaagttgaatggctgtcccatcacgcaatacttttgcctctggtccggaaagcttcttcaagctctgtaacgattgttccgcctttactgtctgtattgttcctaaaattgcattaaccgtaatcactgtcacaattactgcggcgctctctacatctccaagcatacctgatatgactgctgatgcaattaaaataagtaccaaaaaatctttatactgttcaaagaaaatttgaacaatattttttttcttgccttctgcaagctcattccaaccacatttttctctagactttcttgcctgctcacttgtaagtcctaattctttactacctacctgtttaaggacttcttctactgtttgttgataaatttctttcattacgtttcagcctcctctgtttactaatgtactctgcttattatgcaatgaaagactctttcgataaaaatgtataaaaaaagaaaccattattgcataacaaaaaatgcaataaaagtctcaccatttttttgtggcaccggatgtctccatcgtactgacgataccacaaacgctatttacaacgtaggttactcccctttattagtactaatcatatactaaaaatgctcccctgtcaatataaaagattaacagacaccctaattcatgctaaaataaaactaacaaatacacaaaagtaggaggtatccattatgaaagaatcatttgtgcacgtatacaccgggaatggcaaaggaaaaagtacagcggcgtttggtttggctttaagagccttgtttgccggaaagaaagtgtatattgcccagtttatcaaagacatgaaataccacgaaaccggcatagaaactgtaatggacggcatcaaaatcgaacagcttggggctggctgtttcattgaccgaaaacctaatgaacatgatagagaagtcgcaactgcagctttacaaaaatgcggaaaaattttggaatccggcaagtttgatgtggtgattttagatgagattacaatcgccctatatttcaaattattttccagtgaagacgtaattaaaattttgcaaagtcgaaacccaaaagtagaagtcgtcctcactggaagatatgcaccgcaggagcttattgattacgcagatttggttacggaaatgcgtgaagtcaagcactattatactcagggtgttctatccagagatggtattgatgtgtaacaaatcgcaaaatcatcaatcctattcataaactatttcagttcgcaggtaaaatgctggcgcagctgtgccggattttcacactccttgccaaaatcaataaaactgcgtccgctgtgaactgcaatatacagcctgcctccaaagttgagatttataatgctctaaacacctgagcaaaaacagtgggaagcaattacagccagctttccagaacatcattcagcttattcatatccagcggttttgcgatatgtccattcatgcctgtatttttgtcaagctgtacgtcttctgcaaaagcattggcagtcatggcaacaataggcagttttcccttttcacccggaagactcctgattgccgctgttgcctcataaccattcataacaggcatttggatatccataaaaataagatcatacgaacctttcggagaagcttccattttctcaactgcaattttcccattttctgccgtttccacttttgcacctgtcatctgcaaaatttcaccagcaatttctctgttcaactcattatcctcaaccagcagaatccttttttccgtgtagtctgattttgacagcttctccaaataatttcttgctgttttttcttttcttcctgaagtaaactgccgcagtgtagccgtcagccgagaacggaacagcggttttgcaataaaagcatctatgcccgccgtctttgcttcttcttcaatctcgctgaattcataagatgtcaatacaatgatggtgatctcttttcctatccgtttccggatctgtctggcagtctctataccatccatatccggcatcttccagtctaaaataacagcaaagtaatcatctttcaactcatgccgtgcataacagtgctcaaccgcttccctgccagagagaacccattcacccataataccgatttccttcagtgtggcaactgtactttcacagcatgtcttatcatcatccactaccagaaccggcagattcatcagatttttgtcctgttctttttctttttcctgaagctccagataaattgttactgtgattttagttcccttgtgcaagatactatccactttaatagtgccattcatcaggttcacaatatttctgctgattgccattcccagaccggttccctggactctggttgtccggtggtcatccgcgcgactgaacggatcaaacatgattttctggaattccggtgacataccgatcccattatcctcaatcgtaaattcataacatccaagttctgaaaatccatttgacttttcctctatggaaaaaataatattcccgccatccggtgtatacttgatcgcattactcatcagattcacaaatacctgctgaatcctcaagctgtcaccacagacagcctcatgttcaatatgattgatgtgtatatcaaaattatgttgatgttcatcaagcagcggtttcgtaagtgtaataagattatctaccagctctgacaaattgaaatcttcctgtgccagtgtcatttttccactttcaatacgtgccatatccaatacttcattgatcagccccagcagatggcggcttgattctgtgatcttgccgaggcattcaatgactctgtcctggctctcaacatttgctcctgcgattgccgtcagacccacaatcgcattcattggtgtccggatatcatgggacatattgttaaggaattctgttttcgcacgatttgcattttctgcggaccggtaagcctctttcagcgcctgacgagattcaatctctgctttcttctcctgcgtcacatccatggatgccagcaatacttttaccagttttccattctcccattctaacggaatataagaagcgattttataagtcttttcatcccggctgcagtactcaaacttataaatatcattttcacctttcagattcttccggatattatccgaagttatcaggatatccatagcctgcagtggttccagcgtcttatacttttcaagaacctgcatctgaaaatcatgataaaagcccagaggtttatataccatctgcccattcaggttgtaaaattcatatctgtcattttccagatcacagacaacaaagcggtcaaccagacgcacaatactctgaatcagctgctccatggaagcattatccgctgccatctgcagatgccgtgcgctctctacctttgcctctgtgatatcacgcagaaagatcatggcatattctgaatcctctatttcgccacgtatgaccacattgcggacccatcgttcttttccattcagagtgatacggcactctaaagccaattcggtttccagacccttcagcctttctgcaatataaccacggtcgtaaaaagaggataccgccttcttatctgtctccacaacataggaatccacaaaatgccgaatcaattcatcccacgtatgactctgttcaaagacggtcatcagggacggttcaaccttaaaggtatcaaaagtattcgcttccagattcacataatactcgcacaaatctgctttcgtaaaagcccggtggaaagcagcagatttttgtgcctgcatgatttcttttttctccccatcaatgttaataaaaatcccggcaatcctgctagcagaaccatccagacggcgtattacttctgccgatgcccgaaaccactggtattgattatccttcattctcatacgatactctacctggtattttatctggttcgtcttatccttaattgccgcctgaagctgcaccatgactctttctttatcctgtggatgcagaagatctgaccaggattccagtttattcggaaagtccagagtgtcatgatagccaagcatttttcggaattcatgactccagtttgcattcacaatctcactgttttcgtcacagtcaaaataccagaagccggaacagatagcctcattgagcagtgccagatttacatgatcccagttgacctgtacggacataacccagatctgtctgcccgcctcatctgtcgcatcctctttacaaagccgtacattattcactgtaccatctgctgcaaggatctgtgcttcccctgttccgtgaagctgcaaaaaacggtcctgatccagtatctctataccatctccataaaagaagtttttcaatgaacctttcgtctgcttcataaaagaatcaaaggtataccctgtactatgtaacagcagattgctcacagacaaaatagacaggttttggtcataatatcctgtcattatacctactccgccattattttccagtgttttctgtactacctgtgacatagcccgtgtttgtcccgatacagtctcacttaaagaatatattttatcttcataatttcccattttataaaaatcctcacttcgttttatacctttttcatcctgcttcaatctgcctattgaaaattttcttgctgtctaatgatttctgataatgtcgacagcaacttatcaacttggattggctttgctatatgaccattcattccagccgcaagagccgctttcttatcttcttcaaatgcatttgccgtcattgcaatgattggtatacacgttttagctttatctggcagatgtctaatttcctgtgttgctttataaccgtccattttgggcatctgaatatccataagcaccatatcgtacgtacccaccggcatttccattatcctgtttatacactgaatgccattctccacacgttctgttttaagaccggcacgctccagtattatttctgcaatctccgcattcaaatcattgtcctctgctaaaaggacattcctgcctttcaggatcccactacctgtttcttggttttcaacatatttttttgcataatagcttttatccgctatcttgtgctttagtgtaactataaagacgcttccctttccaagctcactttctacatttattgttccaccaagcagagcaacatatttttttacgattgacattcccagtccggttcctgtgattttgctctttgtggtgttctgttcccgtgtgaacggctcaaaaatctttgtcagataatcctgactcataccgattccggtatcgctcacccgagttcttactattatgtatcctgactcatcgcatggtaattcctctacgtttaccgtaacaaaaccgccggataaagtatatttcatggcattgctcatgatattaacaaatatttcctctatcttggtaacgtctgtcaatatgtgcttatgctctacatccaccttgtaatgaaatacaatattcttcttctttgcttcatcctcaaatagttcaaacaaattctgccagatagcttcaatctgggcataattctcatcaatctccatccttccgctctcaatccgagccatatcaagtacattgtttatgattgacaaaaggattctgccggactgttgcagtttttccagatgttttgaagtttcggtcagttcttttccttttagttcatcctccataagctgtgcatagcccagaattgcattcataggagtacggatgtcatgcgacatattgttaagaaaatttgtctttgcaagactggcattttctgcttttttcagagcaatttccagcttatcattgagtttttgtgtattatttgccgcaagctttgcgacagtttccgctttttttgcctttcttaaaagtacgagaataatgccaattatactaaaggaagaaaaacctatggtgacaaaaacaacaagcagattgtcttttacaaagtcagaaaatgtcaccttacctgccgtactgtcataaatagcaattgcacttgtaagcatatcagacggcatggcctttaaagttttattcagtatcgacaaaagagctgcctctccacttcttatcgcaaagcatgcctccattgtttttgtaagtggaacacttttgaaactccggctgttatcatatatcatcgcctgacttgctcccatgaggaaacagtctgctttttcaccggaaaccatatttgcagcatcctcaagcgaatcacaatctacaagcttccattgtggataactgaacgcaatatgctgttttaaggcatctttttccttttgcacagctactgtatacacattattttcatcaaactttttctcatctgttaccgccatcagactgtaagtccacgctgtatttgtaagtgcatatcctttttcttctgcaaaatcaggatttctgctggtataaaaaataatatcaatttcatgttcctgtagcgcctgagtcatttcgtcataattatcatacgacttcatattaaactccagtgtctgatcattcaggcaatcttttgcataagagatatattctgacagcatgccggtaagttttccagtctcttcatccatagaaaagattgccggatcattgtttaaaaatcctacccagatatcaccatgttcttccagataggacttttcttcacctgtaagaatctgattataatcaagagtaaaatacttcttatacagatctgcctgaaaaaaaggactatcttgagccaactgacgcatagcccagtccagttccgtcttgacatcgctgcgctctttgttcattacaaaatatatacctgatttaccaatattggtaacagatgatattccctgttcagaccagatggattcctccaaagatataaaacagtctatctcatgatttgctaatttcttttcaacatcatcattattatacacatttatatgttctgtatttatgccgttcttatcttcccactctgtcagcatgatttcaggttctgtacccatgagcacacctacacgtttcccatccagagacttaaaatcagaagtcacaatatccgtatttgacaaatcagcataaagaatatatttttcctctcccatcggttcctcggaaaaaagcatcttttctgtacgttcatcggtgtaagagatatcacccataatatcaatctcacccttttcaagcatgtcaaaacagtttgaccagtcacatttcacatactcaaatttccatccggtatagcttgccagagcctgcatgagttcgtagccaaatcctcgtctgacaccgtttttatcaatataattaaaggtatcctcaaacgaaccgacacggatgatcttctgctcttttgcctgcatgtctgatttttttgtttcctgttgcgttgaattatcctgctttgccatctgtagctgttctttatcattatctgtttcagcagcccagcaatgtactgataacatcatccacattcctaaaaccacaagtatacctatacataatacgactaatctttttctacttttgtacattgctcttttctccacaatttaccaggttattacccagcactgattttctatttatcgttttccctacctttttcatcattatatcttgtattgttaacttcggtcaacaatgcactcttatttttgtcttttttgtggatatcattaaatttaatttaacctcaacagattcattaccaattttaccattacatctttttcttccgcttttgattcagcaatcattaatgtaattgctactaacgttccatcactgagtctcttctctccatcctgaaacagcgcattgttcttgtctaaaaattccaggaacagtgatgcggcaattcttttacagccatctgcgtatggatgatcttttatcataaaatacaataaatttgccgctttctcttccaaagacggatacgcatcttgtccaaatacactttggtaaactgcagcaataattccttctaccttaccggtctctttttccacaccaaatacatctgtttcaaaagaatccttcatctgtccaaccatctgaacacaatcttcataagtaatgcggtatatcggagtacttccctctggcttacttaatgcctggtggtcatattgatccagaagaatcaatgcatccgtgtattcatttatagctctgagcacatttttttcttctatgtcaagtgcatccacaagcatccttgactgaatatcaactgttttcctaagtgcctgaagatgattttcattgagcgcatagcctttcaaaataaactgtttaagaacactattgacccattttctgaaagcgatacctcttttggaatgaactcgataccctacagacaaaatcatatccaaattataaatcttaggttttcttccccccgtacttctgtcggaaaagccgacagaagtctcatccaattctcctgaagcaagaatatttgagatatgtttgcttactgtagcgcgcttaacctcaaacaacgcttccatttgtttttgagtcagccagacagtctcttgctcaggattaatttgaacttctatattaacatcaccatctgtaaataatacaatttcactcttcatcttttcgttcctttccatgaatatttcacgctgacttttccaaaccccattttcagtcagactactttttatcctttgatttataaatgagtagtgaaaacccataggcaaacctatgggttttcactactcatttatcttttttcattctttcactccgcccgtttttaagtattcatccgcatttttacatattttattaaatacttctgtacatatgcgcctttcttcttgggttagtccctgcaagaccgtttttacaaactcattctgcactttaattccatcttctatgatcggaatagctgcctccaataaaacaatctcgatatgcttcttattgtcagtgctttggactcgctttaccaggtctctgctttcaagatttttcaaggaagaggacacatgagattttgtggatttgcggattttgacaatctccgctgccgtattatgccgtggattgttatgcaaaaatatcagtatgtcatattccatctgtgttaactggtatttctcacatacttttcttgaaagcatttcataacaacttgagattgtcttatgttgatcccaaaaaaacatagcgtttctccttcctttcacttcgttctatttagaacgattatatggtgtctatatccccttgtcaacccttacttataattttttccacgattttctgagtgccacataggaaatcagaaaatttgcaaaccagccagctggtacagcaagccagacaaatgagatgccaaaacgaggtgcacagagcaaagcaactgacagacggattgccaggtttaccatattcgcaatgagaaaaggctgcatgattccaagtccgcgaagaactccatccgttgccatcttgatacccataaaaataaaaaagcagccgagccatctcatataatccccggacacctgatatgccaaagcggttccatccttacccagaaataacgaggaaatttgagtatgcagtgtttcaatgattataaaagcaagaactgcaaaacacagatccaataccagtgcagcatgatacccttttttgatacgcttgggtttctttgcgccaagattctgggatacatacggtgagactgcatttccaatagatacaaagatcaatgaaaaaacattttccacccgcatcgttgctgaataaccagcgagtgcctgtgtaccaaatggatttacaactgcctgtacgatcatcataccaattgatactgtggactgttggagaattgatggcacggcgatttgaagcatagaatacaactcctgcccattaaaccaggcaaaatgacttttatatcggcgcatccgactaaagaaaatcaaaagcgaaaacactgcggaaatcccctgtgcaatgagagttgcaagggctgcgccgaacacacccagaccaagtccggccaccatccaaagatccataaatatattcaaaacagaagagaatatcaaaagacccaatggaatttttgactctccgatagatgtgaacatcgttgaaaggatattgtacataaacagaaacggaaagcctacaaaataaacgcgaagatacagcactgcttcatccagtatatcagctggtgtctgtaataagttcatcattgaacgggaaaagcaaaaaccaaaaacccccagaagcatacttagaatcagaaagctaatcaatgatgttgacacgattgttttcattttactataatctctggctccaaaataacggctcacaagcacacctgcgcccacaccggcacccaaggctatacaaatgaagacattcgtaagtgcagcgcaagcaccaactgccgcaagtgcagaagagccgacaaactgaccaacgataatagaatcagccatattatatacttgttgaaaaaagctgcctaaaatcataggcattgcaaaaacagtcaatgctttcagaggcgcatctgtgatcaaatattcatcctttgacattatcttattttctcctccatcagaattttttgtattttcgaaatgtaagttataagtttcgttatgtaataattatatgtagttacagtaactaagtcaagctatcatttactttttgtaatataaatggtatgatatttgatatgcaatggatattattttacaggagggacaattatgtacctagacggtttagatgaactggatcagaagattatccagttgcttatagaaaatgcacgtatctcttactctgatattggtgaaaaaaccggtatttccagagtagcagtaaaagcccgaattcaaagcttggagaaaaaaggtataatcgaagaatatacaacaataataaaccctcaaaaaattagtggtgctgtatcatgctattttgaaattgaaataaagccggaccatctatcgcaggtaacagatatattgtataaaaatgatacagttacacagatttaccgtgttacaggaagagacaaacttcatatacatgcagttgcttcgtcaagtgatgaaatggaatacttcctgtacaatgtcattgacacactgcctggcattatcaactgcagctgcaataccatcttatcacgcattaaagatattaaaggattacggctatgaattatatccaatttagacattgtatagcttaatcccgacattctcatgggatagtaaatttaaagaagtttctgtgggagtactaaacgaatttacaaggctcctcacacctccaaaggaagtggaaagagcctatgacaaacaaaaggattttatttatgaaataaacagccgttcctgatatcctgctctttttgaaatcccgccactccactatgcatatctccatcttttttcactgcctccacccgatacaacattacagaattcaaaacatcatccagcaaaattccggctgcaagaaaacttctctgtcttttataggccggaaaagtctctatttgccctattattaaatttcgtaattccaaatttctctgaatgatctgataaagaagtcttcctcacacagtgccttggtcaaatgcatgtggatttccagtcaccattgcagcaaaaactgccaggtatattttttgtgttttcctgtatggcagtttattaaatatttctgcggaaagctttaactgttgctccagttcttcaaaatcttccctggaatttcctttcagcatttgcatgaaatattccaactccacctgtgccggtgtcccctcatactcgctactcatgcgcagtagcaattcctgctgtttctgcgcctttaagattctttcttcctgtttgctacacagtgcttttccaaaatagctttccagaatctcttccggtgcaagtcctttatagcgactattttctaatactttttgaaatttttcagcagagattgtcacacttttttgccgatgaaaactttttccaaagaatccttccaattcttccagttcttccggcgataagctctgaacacgaacgctccctgaaaatcttccataagaagcatatttttcaaaaaaaccgttcagtaccttttcccatactgaattttgccgaaaatattctacacatttcttcagttgctcatatagaactatatttcaagattttctttgcatattcataaaaaagcgttataatcgaagcagttaaatcaaaggaggtatcaaatcatgaaatcacataaatactggtctctcggagcacttttctgtatgttgggatgcatttattctggaatcaaaaaatctatgactgcacataaatactttgcctattcttcattgctttgtatgggcatgtccatttattccggtcacaaactggtttctccaaagaagaaaaaaatcactgaatcaaacaatagtgaaaataattgaacaaaaaattgacctctattcatcaaagacaaaattgctggagattatttccctccagcaactttctttatctttaagccattaaaacacaatactgtccaatcagcttcgtccaactattatatttattcttttcacacacctttcggcaaatttcattttccatcaatacacaaaacatcttatcataatccaatgcccaaacagcaccattcacatggttctctactgctttctgatctatgcttttcaagcgtgtgaccattttttcaatttctccattttctaagttaccgatatttttgcagataaaccaaaagaaattcaacgttgcatattcgtcatgccaatggaactcttctggattgttttttattttactggctcgctgctgttctttgattatctgatcagctacacctttcatcgaatcttcgtatctcatattactcacctactcttcctcaacgcccagtgacggtttaaatcttttatcctttgcctgcggtaccacgatctcataaaaataaaatcctaaatacccaagtgcctgcttcttcattttataaaaagaagtcctacctattcctaattcctgctgtacttccacatccttcttattataatgactgcaaaaacaggaatgaaggatttcactgagcatcacaccattcggtgcatagaacttcaccagtgtcattccacgatagatcatatctgacaagccataaagagaacatgaaatatcatcgtggaaccagttggaaagccaagctacgtgttgccgtggataaggcaatctggtcttctgtcaattacaatgagtttttacagaaaatgcagttggctggatatgaagtccgacagggaaaacatctttctttccgtgcaccagagcaaaaaaatttcacatatatgaaattactggggagttattatacggaagaaaatgtccgtacccgtctggagaaaaaccgttataaaaccaaagcaccaaaacatctgtcccaagaggctcgactatatatcaatatttccacgtatgtcactaccggtaactgggaaggatttgaacgttgggcaaaactcaataatctgaaagaagcggcacgcaccttcaattatctttccgaaaataatctgctaaactacgaagactttcagcagcatatttccgatatggaaaattctgttaaagcggctgagcagcggattgaagaaatcagtgcagaactgggtactcagagactcatccaaaagcattgcgattcttatcgactctgccgtaaggtaattgaagattgcaaatctgctaaaaatccaaaagcataccgggtcaaacatcaaacagaataccaactgcacgattcactaaaaaaagagcttcaggatctgggcgttaccaaaatccctagctctaaaaaaaccggaaacggattgaaaaccttgaatctaaacaggctgctactgtccgggagaaacaagaattgctgaaaaagcaaaagactttaaatatcattcgtcaaaatttcactgctctgcttagtgaacaaagttcacagatttacccttctcaacgagataatgtacaactataaaatgttttgctttagtcgactgatatgtaagaagaacactgactgcaaaatcagtgtccttctttcttcttttacatatatttcataatagtcggcaataatacattcatatctattggttttgcaacatgatcattcatgccacttgccaaagccatcttcttatcttcttcaaacgcatttgctgtcattgcaacaattggaatctgcgatttgttaccgtctttcagttctcgaattctcctggatgcttcatatccgttcataatcggcatctgaatatccatcagaatcagactgtagtaattttgctttgctttgttaaacatatcaatacatgcaacgccgttttccgctctttctatcatgattccctcttccgtcaaaagttccgttgcaatttctgcgttcaagtcattatcttctaccagaagaaccctttttccttccagttttttgatattcaactgaccgtctgcatgtttcggattcctttcttccgcatttgctatttttaatggaagcgtgattgtaaaagtagaacctgctcccggtttgctctgaactgtgatcttgccattcattaaatccaccagtttcttcacgattcccatgccaagtccgctaccttctattccgctgtctgacgaagatcgttcctgtgaaaatgattcaaaaatatgtttttggaattcttctgacattccgattccgttgtctgctatgataagctctaatacactccaaccttctttttcgccgggatattggttcaatgtacagcctatgttaccgccttcacccgtgtatttcacagcattactcaaaatgttaatcgtaatttcagatgatcttgcatcatccatatacaagtatggatatcgaatgttcttattgactttcagtgtttgatgtttttcttctatctgtttcctaaacatatcaatacataaatcaaagtttttagaaacatctgttattgtttcatccagcgttgctttgttgttttcgattcgtgctaattcaagaatgttatcaatcaaatgcagcattttctttccgcacaataatattttttcaaagtaatcttctaatatagttggctcctttaaatgtttctctcccaattctgcatatccaatgattgcattcataggggtacgaatatcatgagacatattaaatagaaatgttgattttgctttattagctgaatcggccagtcttgcagcttcctgcaacagtttttgctgtttctgctcattttctttttgcttcttatatgcagaatatccacaggtacataatattaacaaaatacacgctgtaatgcatcccagtacaatacttagcttattcgtcttctcaaccattccatacgctttctgcatatccatttctatgcagaaagcacctatcacttcattagattcatcttccgctgtcacaggataacaggctgtaaaaataggtccccatgttgtatcaacaatatcctgagaatatactatttttccagaaagtgctttttctatataaggaaccatctccttttcaatcggatctcctggatgtctgacgtcaccagccgatggatccagtccgtctacaacgtaaatcaatctaccgtcttcatttctggttgctgtgtaaatatatctcgtagaattcagcgttctgatttcattcatatatgtcgacatattcttgaatagttctgtattctcatcagctttactttttatttcattaaaatcttttcgtcccagtctgtcatttaccagcttatgaaccgcatctgcactggaaatatctcgttcaatttctgttttcagagcagttttggtatatgcttgttgtaaaataaaagtatatgcaacaacagccaaaatcaccattgccagaaggaataccaaccgtccctcaaaaattttccaatgatttaccggattttgatcttttcttttttgttttatatagttatttttcatcatcgtatttcacatgccttttccctaattttaatttaatacaaaaatgcctcaactcttcacgtattttgcaatatagtggttcagttgtcaagacaaaaatctaagcattttataatgaactgatatatgtaactgggtaggggagaaaatcccccctttctgtagtgtttacagtatgtcagattcattaagaaatgtctcttgaagtgtcttaaattacgataccattatagaatgcactgccgtaaagtgattgaagatttcaaatctgctaaaaatccaaacgcataccggaccaaacatcaagcagaataccaactccacgattcactaaaaaaagagcttcaggatctcggtgttaccaaaatcccaagctctaataaaatccagaagcggatagaaaatcttaaatctgaacaggctgctactgtccgtgaaaagcaggaattgcagaaaaagcagaagacactggatatcatcagacagaatttcacagcactgcttaatgctcctcaaatatcaaacaacgatatctctcgtaccgttgcatcctctcttcaacattagtgtttgcaacgttttaagacgtataatacaagaaaactgattccaccgcaatggatcagttttctttaaataatagctacttcatttttctcttttatagagtcctacaatcaaaccaagactaacaatcgctattaaaaaccatgcaactatatttgttgtatctccggtttttaccgtatttattattttctgaatagtatttggcttatccggttttgaaggtgtcgtatcctttggcttatctggattgctcggtggtgtttctgatgaaacccattcagcttttggctctatcgttacattatattctacattcccattaatttcagatgaaatattaacaaggaatggagcggattcaaatttatctgtaccactttctacatttccaatctgtgcaagcaggtaaattccttcatccaattctccaaaactcgtgcatcccgaagtatctgtttcttgcattaatccggaaatattattttctttcgcaaatgcaaacaattgttttgcttgtttctctcttgcttctgcactggtatcttgtaatgatatccctgaatctttaaaaccatcttcccatactaactcattatttttcatatattgaattggaaatatcgagaactttgctccggaaagagtcacttctttatccgaactatttctccctttataaataatttgaatgcttcctgttctacttcctgcttcagcatggattgttgaaatatctataaaattaccgacaagaaaaagcataacgaataaaataatgtgaatacttcttatcttctttctcaccttactttcctcctttttctatctcgtatactataaattatagctatcatcagccctatgaagattactacaattgttacaatcagcactttagcagtgaaagataactctggttttatattggtatcaggctcttgctttgttgcctcttcataaggtattctctctccacgaactaaaagtctatgtgtgttgattgcaaatggtgtacaagtaacaagtgttgcataatccttacctggttcaatggataagctatctgtctcttgtggcaaaaccgttaatatctgatcaatctgatatgccagggtttcatctaagactttaatgtaaaaaatatcccctacttccagtttatccatattggtaaatagtgtttttgtcggaagacctctatgtcctgtcagaactgtatgtgtactttctccacctacaggaagagatgtaccccagaaatgtccgacacctgcctgtagcacagcttcacttgttccgtgatagattggaagttctatattaatcttaggaatacgaatgtatcccatcattccagaaccatctacgttcaacagttcctcatagcgagcatctatttccacatcttcttgcgaaaatggatcaatcaaatcaatatttcccagcatttccttattgtatgctctcgcatcttccaacatctgctctttttctgccttacttaactttatactttcctcatcataataagatacaactttggaaccattcttttcgttcagataactactaaacgttggatataacaatacggagaatgcaaccaaaagcacgatcaaacgaataatatcttttattgttatcttcttttttttcttcttactcttcatttcattctccctgttgttatacttggaattgcggttaccttccgtggaagataaccgcccattccttaaatattatcttgtatctctggtaaaattattatgcttcttttctcttatcacggataaagcttactgctacaccgaatacaagaagagctgcgattacagcaaatgcaattgctccacgtccaccagtggatggaaggagggaacctgtgctgttttcgatatcgatgattttgtctttctcatctactccatctttggaaatagtccaattatttacatctgcatctgcactttttttgattgttactttaatcggagctgtcagcttgttgtatcctgctggagcctctgtctctacaagccagtaatctcctgctttaagaccatttacatgaaggttataattttccccttcaatacttgctactgattcaaatactgtattcttagatgttggatctactacatattttccatcgcttcctgaaaccgtaatagcgtttgttccagcttttgcatctgcctctgttgtataaaggctaaattttgcacctgccagctctttttcactagtcttttccttctttaaaatatccagtgggtaagtcggtgtctttgcttcacttggtgttgtttttgttgtttcctttggattattaccgtactctaactgagcattattcttttctgttacaactgcgtctttatttacttttgcataatatgtaacagtaaatgcttttcctttgtttgtctgattagctcttacccattcagataaatcaagagacatttttttcttgtttgttgaatcaagtgttgctgttgtaggtgctttgcttgcatctgcaatttcttctccaaatgctactgctacagtaactgttgtagcaccttcttcaagagctgttccatttgcatcatttacaaaatcaagacctttagataattcatcgtgaataatgtactgatactggtcatatcctgttgtatccgggattgcacctgttactgtatattttactacctgaccgatttctgctgtttctttgtctgctgtttttgtaatacttggtgcttctgtttttaagtttactgtagttgttgtctcatcaactgtaactaaagaagactgaatctcttttccacctgttacatatacaagatagtaaccagctgctaaattttcaaatgtataagatgttttattttcttctgtgatttttccagaatttgctgtagctgataatttctttgtcagtgcctctgcagtaaaatcatttgcaaacttctgtactgcaccttctgtatctttaagagctaaaacagctgctgcatactcctcatctgttgttcctgtaaatgatgttccaagggctgatttaatcgcatctttataaccagtttcagtattcactgtatatgcatagttctttgattctgttgtaccagactctgtcacatcaaataatttgtacagattaattgtctgacctttcagatcctgtgctggtgttgttgttttcacattaactgtaagtgtgagtgttcctgttgcaccttctgcggcaaatgctgtgacagacatagccatcatcataatcgctgccagcattaatgccatgatttttttcattctcttcataacaattgtctccttttcttgagaatttttcttttatagtttttctgcttttttattttccttgcattttttatatctcattacgaaatataccaggaaaagcagaacagctatcaggtaaatcaaataacttccgtatcctccggtatccggaagacctgggaaatgtctattagttattgtgaaggtaaatccatcttgcgatttatctatcgttgttgtataaccatccacttttgcttctgtgatggaatacgtgtaataataaatttcatctccatctgtcttgtatgccgggagttcctttatcacctcctgccatttagatttatcgatggaaccttctattttgtaactctcgtaacgtggaactgtttctgtcttttcatttcctgtcttatctttccaggtacgtgatattgttaccgtaatactgtttggtcttgaatgatcaaaattgtttaaatccttccaaactttattgatcgtcagcttgatgttctcatcacatggatcctgtgactcggatggttccggtgtatcactatctcccgtgttcaatgttgttttggtatctgacatcaatactgcttttgctggtgattcataagcattaagctctgctttcactgagtcacccttacttgccagaacagcattttttagagtctcaaaagtctttaccggattcatatgtcctattgtataaatatcccatccgcttgcatcatccttttcatgactgctgttcaagatactgttattctttttaatttcatctaaagattgatctaattttctgtaaatacggtaattattgttctcgccttccaccttatctaatgtattgaattgatattgcgaatccaattcactctttccgctaaacggtccgacaagattttttgttccacgaaccacatcacagtaatacatgttgttattcttcaaaagtccttcatcgttgaatccaacaaaaccaccacttcgtccatctttagcatcaccgtcattgtcatttccggctccaccggcatagacatcatacccatgactgacaccgtagacattactatcagtaattcttgttcgattggccttgatcagactcacactgatattggatttggcatcattatcattcaacaatccattttcgtcgcatcgaagtttgatggatgaatctccaatcgtaataattgcaagatctgtctcctggttgttatctgttgacttcttcgaaagtcccacagagatatccagtccgagcagatttacatgaagcagtttgccctcatacagtgcatccactttgataattccaagattgatcttcagaagattggaatcctggattttatccagatataatgcttttataagttcattaacaagcgagaatattacattcactgctccagaatccaacttcaaatctgcaagataagcgaaacttgttcgtcctgcaaatccgccggctgttccacctgacgctacctgtttcagtccaattttctggttcgtcttgtcacctgctgtacaattcgacattcttgcaagatttgcatatccgataaatcctccggcaatctgctcatctccatttgtactctgcacagtgtaaccctcatcagttcctgtaactgcacagtcatcaatgtgagaaccaaaaatgtccataactccaagagcaccaccaagcaactgtcctgtattgtctccaataacgtctatcttgtctgccttaactactccgctctttccagaatagccgacaaatcctccgacactattcaaacctcttacattacttaattctgttactttactgtttttcacagaaccatttagcaatgagccgccaaaacctccggctgttccgctatatgtaacctggttgttctgtccggattttattgctgtgtttgcgctgacacttaaaccagcatccttacttccgtttacagttccgtaatatacataacttctaaatgaatccagcacatcggttcttccaagctttaataatttatcaaggagcgaggtctcatttcctgcactgatattggcaactccggctacgtcagcaacaccgaagcatcctccggcatattcacctgctactacagaacgaatattctttacatgaataccagcttcaggtgtacccttttcaccaagaactgtaccttccagcattcctgcaaaacctcctgcagtttttgcgtaagaagtattattcttacctgttgtatatgcaccatttacgatatatccccagtcatcccaggattcaacatctgcataacgtattgtcgcaactgtcgcattaagtactttaataaggtctgcaggagtatcgagtagtttattaagaagcttacttaataatccttcacctgcagtagggttgagtgtagctacactaccaggtctagagcttcctacaaagccgcctacgtagcttctaccatctactcgtctgagtttcttaacctgacaatgtgcagtattgtcaccccagatttgtccaccaagaagtttaccgacatatccaccggcataaccacagttatccttattatcaattcctgtagattcaaccattaatccactctgatatccttctacagaagattgcttgataacaggtacaaacacattcagtacattgatcattcgtcctaaatcaagtttaagacctaaaatattcacaccaccaagatctgcagcaccaccattgatcatttctcctgcaaaaccacctgcagttctcataccagtgacacgttttgtctgatatgcctgaccatttgtgatagtacctgtctgcattgatccaacataaccgccagctgctccgccatttgccagttttgtctcatctcgataattaactcttcctgctacaacattgtatccgtaagcatactttcctatgatcgcatccagttcagcctgattagttactgttccatgctcagcaagatcacttccgtaaccaccttttttaccgacaaatttcacccatttgttccaggtttcataatccatctgggcaagtggtccataaactgccgtattttcttccgtcggatagacaacactgagtgctccaaggatgttatctacttttaccagtccccataataaggacagatttccggtacttgctgtatcggctgactccataagacctgtgaaaccaccagcaatttctcttccgtataccgaacggattcttactgctttacaagtacttgttggtccggtatattcttctttacctttccatttctttgtattgtttccccagatgtgaccgccttcattatgtcctgcataacctccggccatacctcgttgtacctgtgttgtggaagccgcatctgcacgaactgcaccaccacaaggaatacaagtcgtagagctgtttctgatcgtcggtacaaagtcctccgctaatgatgccaatgtatctgacacattaacaagaccatctaagataccagtatcgccaaggacatttgccacatttcctggctgcaagtctcccacataaccaccggctgtaatctggccaatgatataagaaaagttatttgcatttgaatcctgaatgtgcccaccagaaatctttccggcaaaaccacctgcatcaccaagtatgtcatttgctgatgcatcggatgctgtatttttccaagttgcttttactgcaaaacctctaacatctcctgtaacattcgaatgttctattgtagaaacaacgacattcaatgcatccagcacatttttgattcctattgagtgaccaagtacgctcaatccttttccaacagaagctgcggaaccaatattcatataaccaatatatccaccggcatatcttgcacccgttactgcatatgtactatcctgtctaaaataatttgaactatcttcaccctctaaatttttaggaggtgttacctttgtatattttaaatttgttacatcacaatgactaacttgaactccactgccataaccaataaagccaccagcactaccagaattcgtatcatccgatttgattttattagccgtaaccgtaaatccattatcggatttaactcctgcatattctattgttggaacatatgcatttactaagtttaacaactctccaatgtttatattcagcccatctatatttcctagaatactaatacctttactagcatcggccaatgctccagaataaacatttccaccaaagccacctgcataggtttgaccatttacagaatctaaattgtatactgcgtaataatcattagttcctcgtgaactgttatcaactgtaccactttgaaaatctgctgcaaaaccaccggcaacatctgctgtaacacttccaccattcacaaaagaaaccgtgcaatttgtatatttaggaattaaatatcctacggcatttactaaaccatttgtctctattaatgatttaatcgaattatcatcagcaacttctgctagaccacctgtttttgaaataccaataaatcctgaagcatatccgccattatctgcagccttcactgattttagatttgttacatgagaattttctatttttgtacttccgctttttgcgataaaaccagaagcactataatcacgaaccgaattagaatcacgactaccctttgcgtgtaccgtaaacccatccttaattccatttacatttgtatccttaatttttacttcaattgcttgtcctaaagaaagtaaattattcaatttcaacaaataattcaaacctaacaggttaacagttaatccaccatctgttccagccaaatcaccaggaccagaaagacctataaatccgcctactaagttattgccttctatagaagctaaattattgatactaacagttgttatagaaccaccaatcgcatctccaaatccaccggcaacacgttcatttcccgtaacagcaaatccattctctgcaccatttacatgaacattatctacagtaaacgcaagataagatgcaacgccaagcgttgtatttaataaaccggcaacactggccgtacccattgatccagcaattccaccaacataatcatttcctgtaacacttgataatcccgttaaagagctatcaatcacttgaacagaaccaacatcataaacattatttttccaatatgatattttctgtaaattatccgcattcgattgtgctatatatgcaccattacctcggcctattacaccaccaacatagtcctttccactaacttgcagtggagcatttacagaacatcctaagatatgtgatggattcacaccagcaagagaaagtaaagatgaagttgctccaggattactactcaaaagttttacaacaagatcaactacaccgccaagtaaattatcttttgtgtcatctttacctaggtctgcagcccatccaagagatgcaattcctgcaaaaccaccagcataatttccagaagctgttacagtgagtgcattatccgatttaacattacaattgacagttgatgcattggccaatcctccggcaaaaccaccaatataactttcaccagaaacagacacaactgcattatttaatgaacaatttagaagtaaactttccgtattcatcttaggaagttttgtctctatatccaatgcccctgatagtgttccttcaatcacatcatcacgagctagaccaacaaagccacctacaaaattctttccactaattgtattcgtaccacctgttacagaacaactctctacaatagcacccttttgcataccaataaatccaccggcatattctttatcggatgctgtagaaatagttaaactatttatattacaatttactatcttcggattgatatatcctgttggaattaactttcctaaaggaattgcgttccctaatagaatcttaattaaatcacctaagcctaaacctggaatgacatttaaaatatttgttaataatttaaccaaatcccctaaagcattcgataatccatcatattgagttgaaccaacggcatatccaacaaaaccacctgtatagccattcacattttttacatttgcattattgacttcaatatttgaaatttcaacctgcccttcaactcgcccagcaattactccagttgataaagctgtaggatcttttttacgtgcatctaaaacatcgcctaatgttttgcctaaatcaattttcacttgcccaaaagttaaaataaatgttaacccactcaacaatccacccaataactttcctagagtctgtgtaagtgcacttactaatgtgtctggataataggtttcatttgttgttgtatgaacttttagattatcaaattgaatattagatacctttaccaatcctttactaagaccaatatccttttcacttacttcacttgatattgttgaaaagaatccaacacccatttgttctccaacattaatcttagttgattgatctacagttacattcgataacactggtttatcagttgtatttaaaacattatctttccaaagtccacctttttctgcagatttagctccaatcattgttccttgaaaagtaagaggcttccactctttactgctcaaatctatatctcggaaaataatataatttgcgtttgctgtatatttctgtcctgttgttttgtctatatctaaatcagggtcaatttcacctgttatctgattgactccacacctgcctctggtatgtacccagctatgctgactgtatttgctatcagcatctttaatttgtccaaaagtaaaatctgctactccattctggtctcttgtcaaatcagcatcaccactataaagcatgatcggtttgccacttgaatctgtatcacgtttccataccaaaccatctagatatgcctgataaaccgcaccattaactcgttcatccgtaccaattttcctcagctgctgctcatttccaattaagatataggtcttatctccaatagtcttaacaacttgtcccttaaaatctcgaccttctgtaccttctgtactcactttactcaactgatctgcaaccagttctggtttatccgaattaaacttttgcgataacacataattatgagacttactataagtcagatacgccttatcttcaccatctggatagatcatctgccccataccaaactgtggtgcatcataatctaatgtcataacaggttctgtttcagattcttcctgtgcaagcaccatcaactgatacggattgtaaatgtagatggtatccgtttctttgtcatataaagtcggtgtttcattttcctcaacttctgttcctgtaatagttccggtaaaggaatctgacactgtccagatctgttcagaattcatctggatatcattcatcaaaatgtattgggcatctgcaccgtatttcagctctgtgccttcactatttactacatctccagaaccaatcttttcgtccttatcacccgtgtaaacataatcatctgaaccaatctgttttaattgttcataattataaatgcatattttactatccttataataagcatctatgttatctgttgattccgatttaacatttccaccggacgattccgattcgtcatttttcgagttttcacttgtttcctccgatatcttagattcggattccgtggtgccatttatttcatctgaaactgtggactcggttgatacttcaccattactcttattggcatcatcagaaagtgtcacttgactcgtgttggtacccgatggatttacgtctgccgcatccgcaatattcacttgagaaaataagatagccatacatagtattactgcgataattctgttctctatccttctttttttcttcatatctggacctctaatcttttgccttcacttgttactttaattttgcctttttaaccagttttgctgctttgctgcctcctgaaagcattgcatcagctgatttgaaaacgctccacattcaccatttgaaatcatctgtattgcctcttccggttcatatttccttttgtatgggcgatcattaatcaatgcatcgtaagcatccacaatcccaacgacctgtgcacacattggaattgcattccctttcaaaccgtccggatatcctgatccatcatatctttcatggtgatgtctgcatatttcatagctatattgattcagcttttccgttgttatcccttctgggaatctctgggtcatcgctgcacctactaatggatgttgctttactacattcatttcttcatccgtcaattttccatttttatttaaaatttcaattggtacttttatctttccaatatcatgaatcggtgccaaatgagctactgacgcaatttcttcatccgtaatcccgtattccggatattttttctgcaattgaagatatacctgtttcgtatagaaactgatgtcatcttggtaccctgcttcaactaaatgattatgattcaatacagtagttaaaagtgataccatatcccaatactgctttgtcatatcttgttctttttttatgagttctcgttccatctttataactgtgttctggacaattttctcattatgtaaggtaataattgcagtattctcatttgcatctatatatttttttgcttccatccaaacatatgcattcttatcttttccagtaattctgcgatatggaagatctttttccatacatccatcaactagtctttcttctaatccttcacttgataagaagtcatgaaccatttttttgtcagaagcatacacgtatctttctacatattggcttatgaactcttcatagctttctgttttccttactttctcatacacttcacggatatgtgaatatacacactcgtagcttttttccttcaagttcagttttaatacaacataaaatcgtccaaaatatgtatcttctaaatttctggaacaaaaacgatcttcttccaaacaacgattaattgccattgtttcctctacacacgatataatatccattaaagaaatgttctccagttgttttgccagcatgtagccaccatttgtaccttcacaggcagtgactatttttgcatctttcagtttttttgctattgccggaacataattagtagaaacatttagcttccgtgacaattctgatgtagataccatccgttcctgtgctgctaagtaacacacaattctaattgcgtaatctgtcgaattttttagttgcatcgttatccctctaacctaaactctgcgtggtcttagtttatattcaaaaaaatactatcctctgtagtagtgattcttttcctgaaatattttctcatcagtttcccaattatacagattaaaaccggttaatataatgtacaatcaatgaaaatatttatccgtttttttgtaaaatctgttccattgtatcgatattctccattaatatctttttatgaacttcgttcaaaaaaaagaaaccatgcctcaacacgatttttctttctttttctattctatttcttttaacattctataaataattagaccattactgactgccagcacttcatttgcattgtcaaaattaattccagaaatttgttttattttttcaagtctgtaagatatcgttctataatgaacaaacattgcacctgcagttttcttgatgctttggttatttctaagatacatctgcaaggttggaatcaattctcccttatgttcatcatcatataaatataatttctttaatgtttccggaatgcatctttccaattccgtcatatcatcaactttgtcgaatatctggaaaaatccgaggtttgaataatgtactactgacttactcttatcaccagtcacctggcggataatctcaatatacttgatagcctgacttgcttcgtgataagattctttcaatcgttgatacccttccacactttttcctataccaatctgaaagtctgtatctttctttctataaaggatgctttgctggataacctcctctatttcttccatctctttctgatattccagttctgtctgattggaatctacctgttgaatcataacaatctgatccatatttctgtaaataagcgcatccggcaaaagatgcatcaattcaccctcgataacccctacttcgtgaagctgttcttttgtatattttctttgtacattttttgtgatggtatgaaaatcaacaaccctgtaagtatcgctttctttcattccgagctgtgctgccgcttcagtcatttctttcgaactcagtaatccattcagaatattttggataatatctctctgatacgtctttttttcttcatcctgtgcaaattcactcaaaaatccatcctgtaagttaatagtcgcattttcgagttccatacaaacatcctgttctttttttcttagctcctgttctattgttacaatcgtattcggaatcacttttgtattatgaaatgtaataattgctgtattttcctttacatccacatacttactagctttcatccatacatacgatgtaccgttattttcgatgattccgcgatagaaaatttcttcttccacacatccatctacaagatgttctgttaaattctcacctgcaagacatttctggacatttagccagtctgcttcacaaatatatttttccgtatatttttttataaagtcatcatatgattctgctgtttttacttgttcatagacatcatgattatgagaataaatacattcataatctttttctctcagattaacttttataatcacataaaattttccaagatattcatccttaccaggacggataatgtctgatatctttacgctttccaagcggttattgtatatattttgcagatccagcagaatctgatgtactttacagcaggctatataatttttggagcaacctccctctttttccaggcacctgctaattgccatggtgggttctgtacacgatatcacatcccttaaagatatattctctggctgttttgcaatctgatatccaccctttatcccttcacaggcttttatgattcctgcttgttttaatttttttgttatttttggaatataactgtatggaacacttagttcctgagataattctgatgtagagatcatctggctttgcgctgccagataacatacgattctgatagcataatccgttgtacttgtaagctgcatagtttttacccctttccttatctaaactaaactatttcaagtattagttcgtcctaaaaaattggtgggttcctgtcggacgatgaaattgattattcaaaaatttccatcaatttcatcaagatatgggggtcgttctactctatcatcagatataagatctagaattctataaataataatatcgcaacatatagtaatgcgatgatggcttttcaatataattttttctcattgtctatttgaatcagagaatgtttctcatcaacatttctaaaattatataccattttcattttttttataatgttccaaacaggaaaagattttttatttttttgtaaaatctgttccatcgtaccgatactcttccctataatacttttttatgaacttcgttcaaaaaaagaaaccatgcctcaacacgatttctctttctttttctactctatttcttttaacattttataaataatcagaccattactgactgccagtacttcatttgcattgtcaaaatttattccagaaatttgttttattttttcaagcctgtaagatatcgttctataatgaacaaacattgcgtctgcagttttcctgatactttgcttatttctaagatacatctgcaaggttgtaatcaattctcccttatgttcatcatcatataaatataatttctttaatgtttccggaatgtatctttccagttccgtcacatcatcaatttcgccgaatatctggaaaaatccgaggttcgaataatgtactactgacttattcttatcaccagtcaccaggcggataatgtctatatacttgatagcccgacttgcttcgtgataagattctttcagccgttgatacccttccacactttttcctataccaatctgaaagtctgtatctttctttctataaaggatgcttcgctggataacatcctctacttcttccatctctttctgatactccagttctgtctgattggaatctacctgttgaatcataacaatctgatccatatttctgtaaataagcgcatccggcaaaagatacatcaattcacccacgataacacctacttcgtgaagctgttcttttgtatattttctttgtacattttttttgatggtatgaaaatcaacaaccctgtaagtatctctttctttcatgccgagctgtgctgccgcttcagtcatttctttcgaactcagtaatccattcagaatattatggataatatctctctgatacttctttttcacttcatcctgtgcaaattcactcaaaaatccatactgcaagttaataatcgcattctcgattgccatataatcaagttctatcagttctctattttcttctgtgattgttatatatatatccacctcactcaatatggcaaatttcactatatattgaacacagcttcctttcatctgcttcatatattgaaatttcgtaataatattgggtttatatggctgaatttcatctgacaatattaacttggagttgtccaagtttgttgaaaccatacaattaagattaccataatacaatacaacaggattctcgatcatgatgcttaaaaatttgataatatcacttgctgtattgcttgatccattattttttaaaataaacgtattaaaattatcatgtgtaattttaaaatactttaagcgtgcagtgtctttatcgaatacctgcatcataacatgacggataattccccagtaatataaatctcctggaatttctaccagaggaatttcatattttttgcagtgcttttctaataaactcaatctgcgtcctgtaggatcatattcttttcttttctttacaatgaatccacttatatcacttttaactaaatcttcaaaatgctgctctacttctcgatcactgcatgataaatatacctgaagactggttatgagtatttcaccacccgtcaggtatcgctccatatcttcaatttcgattattcgaatgcctttcacttccaaatctagacctttttcaccgcaaagcagcttcatttttggaaattgttctgattcaagtaattttcttacagtatatcccatcgttactccttatccattgccaaatcaatacaacataatatctgttatgttgtttatggacagattatttttcgtacgatataatgttaaataacaccctgctatctgttatgctgttcatattacatagttcctttctgattttttggtagctgtgccctatttaagtaccgcttttggtaaattggctataatctttattatttttattgcttaaagttatcttttagaggaaatgaatgacttgcagaaatagggtagaacaggttaatagaggcactgtacaacataacagatattatgttgtacattccaatatttcctgttcgacaatcttatccagcttcttttggaacactgtttctgtagttgctgtatatattctcgttacattgatactgctatgtccaagtaaatccgcaagacctgtaatatcttttgtcactttataataaatccttgcaaatagatgtcgaaaattatgcgggaatatttttgattctgctactcctgccttttcttttaatcgtttcatttctctccaaatattacttctgtcttttaacttcccatttttcgtgacaaatatccaaccttctgctacttggttattatggcaataggaaagaagtttcctttgcaataccttaggcaaaaaaatccttctatactttcctttattataaatctctatctttccagattttacacgctccactgtaaaatattttatttcactgatccggattcctgtacatgctattgtttcaatacacaatgcaagctgttcttttccttctgccatagctgttgcaatcaatttcctgcattctttttctgtcaattctttctgatcctgtaaaaaaggctgcttctgcacttttattcttttcactttcagctttcctacattcaaaaattccaggaactgattcaaggcggcaagcattgaattaacactattgacagcatatttttgagcaagccattctttatattgcaacaatacttttttattgatccgcttatcatctgccaaaaaagataaaaacttttttatatctgccatatatttattgattgttgcctttgcattttctttctggtatagataatctgcaaatttttctatctcactttctgatacctctattgaaaaatccatctgttccataatcatagtcctcctgagaattcattttctttcattatagctgttcgctttttcgtattcccatacactactttttctacttgttatgtatccacggtttttcaatatttatctccaattatatatcgtattgttgattttagtcaacagtaggcgattatttttatcatcgattgtggatataatttaacaatacgagaggagatgttttatactaatgtcggatagcgaattatgtttacaggaaattggaaaaagaattatggatcgtcgaaaaaagctgggactcactcaagaagcacttgcagaaaaaggtgaagtcactacccagtttgtttcttatgctgaatcagggaagcgagcaatgaggcctgaaaatctgctaaaaatctcctctgctttagaagtaagtgccgattatttactcactggtgaaattatagataaggatctgttgattctttcagataagctccgccgactcactccttcacaggtacgcacagttgaagctattatagatgaatgtaacaacctttttaatcagaaagaaattacccttctctctcaaaaaaggaatggaagctactaaaacagttaatgacattgcgtatttataaagttttttgccgtgcagaaataaaaaaccttgaggtacaagctgatttttgctcatatctcaaggtttaatttctttttgttggtcgctaatcatttttacccttttcaggataattatatttgcaccttaacattcaagttgctcaaactcctttgcgtactgcgtttcatgacacgcaaaggcttgatgttgtatcataaggaggatgacagctccatctaaatttatcgaacaagctataccatttcaactcacatcctcacaaggaggatgaccggaaattatacagaaacgtatcgaacagaccatatttcaactcacatcctcacaaggaggatgacggcgagaactcttggaatcgttatattcttttttatatttcaactcacatcctcacaaggaggatgacctcgttctgctgctttctcatcccagctgtatgactatttcaactcacatcctcacaaggaggatgactctatttctgtgccggcactggacaagatatatatttcaactcacatcctcacaaggaggatgactactgattctcatagttgttcttatcgcaagatatttcaactcacatcctcacaaggaggatgacgataaatactattagtatgaaaatattattagatatttcaactcacatcctcacaaggaggatgactatagtctatcataaccgtacatgtagctttgacatttcaactcacatcctcacaaggaggatgacaaatcagagaaacgattgcaacgctgaaagatgcatttcaactcacatcctcacaaggaggatgacggtagatggctctataccatctttctaggcagtttatttcaactcacatcctcacaaggaggatgacttgttttcttttttttgtcttcttcgtcagcatcgtttatttcaactcacatcctcacaaggaggatgacagtttccgctgctattgttgcatctgtatcatgtccatatttcaactcacatcctcacaaggaggatgactgacttacaaggaccaaaaggtgagaaaggagatatttcaactcacatcctcacaaggaggatgaccttttatacatgggagtggatgaggaatgactgtatttcaactcacatcctcacaaggaggatgacagcatctaatttcgtattaggaattaatagtggaatttcaactcacatcctcacaaggaggatgaccatacgaaaacagtgagcgaaaactgtggcattatatttcaactcacatcctcacaaggaggatgacgatattcatcccatgtacttccattgaaaattttatttcaactcacatcctcacaaggaggatgacccggcaagattcctaattccttgatgaaggtagtatttcaactcacatcctcacaaggaggatgacggatcacatagcttccgctttccatcttgatataatttcaactcacatcctcacaaggaggatgacctactggatttcctggcattttaagtacaaaggtacatttcaactcacatcctcacaaggaggatgacgtaacatattcatgtccgctgaacaagggagatatttcaactcacatcctcacaaggaggatgacgtatatccaaatacacacccttgaatattttcacatttcaactcacatcctcacaaggaggatgaccgttaggtaatttcatataatcacaccttccttatttcaactcacatcctcacaaggaggatgacggcggaaatctgtacatacttagaatctttgttatttcaactcacatcctcacaaggaggatgactactgcacaattttagcttcttccggaacgataacatttcaactcacatcctcacaaggaggatgaccgtttctttttcttctttttcttctttttcttctatttcaactcacatcctcacaaggaggatgactatggtggtggcaagacttaccagttcactcttacatttcaactcacatcctcacaaggaggatgacttcaggtacttgatagcctccgagaacgagaatatttcaactcacatcctcacaaggaggatgacatcaatgttgttcgctctcggaacctttacatacatttcaactcacatcctcacaaggaggatgacgctattagcggcagcaatacatttgcatgacttacatttcaactcacatcctcacaaggaggatgaccttgacgaaagatacgcaattggacatggcattagaatttcaactcacatcctcacaaggaggatgacgaatacttcagttgcacaagacactcaacaggtcgtatttcaactcacatcctcacaaggaggatgactcttcagtggggtaaagatattgttaacggtattgcatttcaactcacatcctcacaaggaggatgacagcaattttaaacaaaaatactctatttaaaatcacattttatatcaacaatagacattttatatctattgttgacatcttttttcattttcatatatatttctaagcctaatttttctccttttctggtgcgaatgtcctagaaaatttatgtgcacttatcattcgcactagaatatcaacatatcctgaacatcaaaaccagacttagcaccaatatgttctactttatttttatatttttcacccagataataaaatctaaggctatctacctctttatctataatgttctccaatatattttttacttgtctacatttggttgcatccatttgacattcaaatacagaattctgtactctctgtccgtaattagtgcattcttttgcaacctttctcaaccgtctcctccctgctgctgtttgagtatttacatcatatgtaattaaaactaacatctgctctcctacttccagaaaaatggtggatactcatctaaatctcctctcaaacatctggctaatagcatactttgaacataaggagccattccccactctattttttcatctataaaaggatgttttatagtttcctgttttttagattgccacgctgataagaaaacttttctcccttcatctgtcataataactgcatcattttcttttcttataaaatatttttctttcataatttttttattaatcagtgtcaatacaaatctatccaccataatacctctaaattcttccataagatctaatgctaatgacattcgaccgggacggtctgtatgaaaaaaacctacatatgggtccaatcctactgcttccagtgctcctccgcacatcccagctaatagggaatatccaaatgacaacattgcatttacattatccaatggcggtcttttatttctcccatggaaataaaaattgtctttttgctgcaaaatcaaatcgtcaaataccgaaaaatatactgaagctgcttctccttctagtccaagtagttcctctgcattttcacattctcttatttttcccatgctctgagctaaaaacactgactttttctttatcgtttccacatctaaacgcagcgcataatctcttgcagctctctccagaatccaccttgaattatatacttttccaagaataaaatttcttgctatatgtacactttcatcccgattatcactgattctatattgttgttttcttaatgtaacattcccttttacttcacctgtaactcgggctagaaatcttccatttccagacataaaagacaaatcaatattcctctgtgcacatactcccataagtgccggactcgctcctgtatagccaaatgtaattatcgcttgtaaattatgtaatggaattcttccgatttctttttgatcttccaatacaacaacattttctccatctaaggacaaatatttatttccagatgtcacatacaacgtatttaaaagtcttttcatcctttttcctcttctgaaataattttatcaatatatccggaaactgactttttcttatttagaacaggtagacaaatgtcttttaatgagcatgcattacattttttacttattttcacttttggagtataacattgcgcgtaatacttgtgcatttccgcaaatatttttctgactttatcgcgtatttcatccgtaaattctacttttgcacgatgctttgtctctccataataaatatagccatatggtattgtgcaacacaacatttcttctaaacataatgcctgtgccgttacttgaaggatatcggaatcatccgtttttggttttcctcttttatattctatcggaaccactttataaaatccttcttttccggacaaactgattccatcctttgctttatgaaattctaccacatcacattcaccgctcactcccatttcccgggagtgaatcggcattgctctcacaactatcaaatcgcctcttttttctttaatacttgcatcgtgagcattttcatgaagaatcttaccttccactgttctgacattttcttgccactgtagttctatatacgctagtgcccattgtctcctgcaaaattcaaaatgctgaattcctgataattgaagaaagtcttcttccttatacaaattaaaattcctccggttgtttgcatccttctacatcccatgaaatctcataatcctcgaattctctcggatgttctttttttgcttcaatagtgaatcctctttgaattttaccactggaaactgccggtgttttttcatcatgctgccaccagtacattttgcaaacttccatacttccttccggtcttgcagaagacgcatcattctcaaataatgtctttaatgcttcttttaatacttccgcatcttcctgactaaaacctgttttttcagcaagttgtacatttacacttcccattaccttatatacagcaaatccaactctgtgttttgttcccatcgtatcagatgctttactttcttttccagattcactattcacactttttgtaatctgcatactgataatatcgattggtgataaacttactgcctgatgaatagaaacaggtccccgtaccccgaaagacaccggaattcctttaaatgcaaagacttgtccaaaagctcttacatctaaccattctttgcatgcaattgctgcacaagcatcacgatttgcatttttcttatttcccatctctgcttttaattcctcacagctatctgctcggtcttttaaactggtataagcatcatctgttctatcatctgactgaacaaaaatcttttgtcctaaatcctgaaaacgatttctaatttttctcttaatacatacatctgaaatttctccaaaaccatccatattaattcgcggacggtttccgtttaatggatctccgtttgggttggcattgtttgcactgataaataatgtgaaatcaatttttccttttaattcgctcatggtctactcctcctctttttactcttctgaactttcttctttttcttcagacttctctttctttaatttcaaatcatatgcctgattatggaaaccaagtagatataaaccttctaatctactgttatcagtaaatgtgcttttatcaaacagctcatcaatttcatgcaatagattttcgtaaaatgtcctttttgcaatatctagcttgttcaaatatggtcgaatattttcctctataactttccacgtttcatatggtctttgagagaaagtgctcatatatctttttgcatttgtaactcttccattatctttctcgtcatatgtcaaatattcaattcgatctgcaactgccagcagtcttccatacagataatttctatctgtttcctttttatctaatgccacgttccattcctccttatatctatcctttttatccttttttacaaacgaacatgctaatgtcaaaactctttcccaatttcttcgttccttatatgctaatggattggatgcctttgatactgcaagcatcacataatcatacggaaccaccctagtgccattccatatacatggaagcaatctttgagctacttgtgcatagagttttttaccattggcatccactatagacaccgttcccttattctcaataccgtataaaatatctgcaatatctttaacaccaaccattcccgcaaattgtattctttctccatctttccattttgtatgaatccagttacaatcgttatgccatttttctatatttttcagatatctgacagaattcagctcttgattttcaatcaacgctaatcttcccggtgttgctgcatcaaaagcaagcaaaatcatattcgaagtattatctatcttttttccatagcctcttagtgccttatagaacttatcggcggtgattggatttccatcggatacaatctcccctgtagaccagtcatcttcccaatcatcctcagcatttccaacatattccctttcatactcagatacaattgcctctgtatctctctcccattttggcatacttaattgatttgactcccatgtcacaattgtcatagtatcgaaaaaagtgccttgttttcgaataatccacttcaaagcattgtgcgctttttgcgaggtctcatttcctactgcaaatgcctcttccttacttgtaaaacgtcctcgataggtgaaattttgactgtcatttgcagaaatcagctttgctccatcaccttcatttctgattttctttgaatgaagataagaaatagattccatatttccagtcagataacatagacctttttctttttcctgtgacctgacatattctatataacattcctgcaacgctctgtctttccaacattcatccggagtttcctgataaagtttttcatcaaaagatcgtataataaatcgtacaaaagcttttggctgtggaattccttgaatattttctttctcatctatttgattttcttcattaagttttataattttatgtgcaattaaatcttgaattaatgtcgattttttcaaatacttataaattgctctgaccttttcatgacaataatcggattctacccatttttcaagctgtgaaatatatagctcgctacatactccatcgtctttataatattttttatagtcaccggcaagatatctcaaattatcacataatggatgtggctcttttccttttcctgtacgacttccagatttttctgtaaccggtataatcgtcgttttgtctttctgttccacttgctctgcacgaataaaatcacctgcttgatcaatcgttaccgttatctgcgccgttacagttgtatgaaatagcggaagaagtacataagggatgtctcttcgatattcgatgataccaattttatctgtatttttctcatacaaatcaatcaattcatttatccagctcaatcttccacctcctcatctgtaaattcttctaatcccacaaaattattcacttcttttccaaatacttttctttccattggacggatatgtcttttctccgtacaatcctccggtctggtaaattctataattccaccctttttcattaccggcctccagaaacgcactgtcatctgatctttatcctcttccagaatcgcctcttccgcataagtaatcccatgatacataaatccataacccacttccccaggcatcgtatcataataactcttgtcttcgccaaatacacacggttccacaaatgcctgacattctcttgttcctaagaaaatatctctgcgaccacctcgttttaccatccttttcgcaatattatgatgcttgttttcatttctatcctgctccagctccggatgattgagattcatctcaaaatgtgcccgcacctgatatctcacatcttttaaataagtataatatgccagttcatttctaccattgtatgcaatcggtcggattcctttagtctcagtctgaattggattcattactcttaccgcgtcaatgatccaaataatcgtaggcttccagtaaatactttccgtaattccttttaatgcttcgtaagtcggaatatgatagcttgtcttttctcctcccactctcataaccggatctgaaaaaagcgcatatgttccatgcacttcaaactctattgtatttctgtatctttccaaaaatctcacctcctctataacatttgcaattccatattaggttcatccacaacacctacttccttgtcataatatccatcacacaataccaatatctctccattgccaatttcatatatagcatttccgagtttttcttttcttttttcagaaattccaactgtatatctctgcaatttttttaaaatctttttctgctcttctatctcgagataatcctgcgataatttatccaatagttctctcgcttcatcattgtatggaaccacaacactaactttataatcattagaaataacttcaaacgcctgtcctgcggtcaaaaaagcctgcggtaattttgtctttactttttctccattccttctgatatattgcaattgtcctactttattttctcccaataactctataatcgtggttgtttgtttatctatcaaaaatttcgtttcatttgttctaagttgggaatagtaatttaaataatatgcttttattgcctcttctgaatccaatgtatctctgaattttaaagaattatttttataatcttccaatactttttgtaatgctgcctgcgcatttctaatttcctgcaaatgacttaatttctctgctttttcggacatctgtacaatgaaaacagttcccattcttcctaattccttatgtctattgcatcgtcctgctgcctgaattatattatccaaacctgctttagacctcacaacacacccgaatgaaaaattcactcctgcttcaacaacctgtgtacttacacatataatctttttcgattgttcattcaaaatttgttttatagattttaatgtatctaatttatgttgtggacacatattattactcaaatgaaaaagttcatattcttgtgtacatatcgcttttaattgttgaaatgtattcattgcacaagccgtagtattcaaaataaccaatgtactttgatattgttctgttttttccttcacaaattcacttaaatcttctatctccataccgccaggatataattctgttgcatctttaatatctgtccttttaaaagcatttgcatacttttccggtcttcccgccatttctatacattcacaaatgttattctcttttattggtgccaatgttggctgcgttgctgaacacaacacaactgtcgtaccccaaaattgagtaagaaaattcacagctaaattgaaaagttccatacattttacaggaattgcctgcacctcatcaaatatgataatactgttacataatgtgtgcattctacggatacagcttttctgagctgaaaacaatgtattcaaaatctgtactgccgtggtcactataatcggtgaatcccaagtttcagtgagtttgcgataccgctcttcttttccatcttcgcaaaccacattacaatgatgctccaatacaatatccgccttgcctattgcttttcgaatctcctctgcattctgaatcaatatagaattgaatggtgctatataaataatatgttgttttttcgtctttttggcatgatataaagcaaaacgcaaactgctgagtgtttttcccgctcctgtcggtacagtaagtcggtaaagattttgttctttgtctgcagcttgtctacacaaatccgaaatttcttgacgaaaagtatttaacacatttccatttgatggattattttgaatttcctttgacatatattgctcaaaattttctatacattcattccaaatcttctgcgtctcttccaatgaaattctttttgataacggaacatcttgaaaaaaacaagccgtatccgtccagtccccatcaataagtaaagataaaactattctcagatacattcccataaagaaatatctgttcccacattttctttttgatatttctgactctttatgaaaagtattgatttttccttccatttccttatatgtttgaattgcttttttgcagtattctactaatatctctttatcataaatctgaaagaattctttctttatccagtcataatctatttgtttttcatcccgttgttgctgtaaactttgtccattatctagattgatgcaatctcccattccgtgatgaaaatatataaccgtactgataaattctgaaacacttttttctttgaacaactccttgattaatcttccgccagcagtagaatgatctaaaccatgtttatgagcatcatccccatattggagaatcttctcaaaatcttcttgattttctcttcccagctttcccacatcatgaaacacccctatcaagctaaccaatatcttcaattctgaaagagaacaagtctccgctgcatagttcgcaacattttccgaatgctctttcattgtctgatatctacctgattcatagtctacgtgcgccaaatctctttttatttcgattttattttccatttatctctcttgtgttatctgtgtatatttttctttattcagttttctattttatatatttttactatattttatcaaattaaagaatgccatacaaggcagaatctaagaaagcattcgctttataaaatatcaaaggattctactttgctcatttccctgtttcatcactacaactccattttccctagtgcaacgcctttgttggacaagcttttgtgcattcatagcaaagaatgcattcagttccattttttcgctttcgggattctttattaacttccacgttcataggacagactctcaagcatttgtcacaatgaatacatttactctcgtcacaatgaacacgtaaaaatgaaaaataactcataggcttgaggaatactataacaggacacagatatttgcagaatgcacgattatccttgagtacaaatgccagtccgatacccaaaatataataaagcacatttcctacgatgaacagccaaaacataatttgttccagctttgcaatttttatcagcatcaaaccggataccaacgctaatgacagtacaaacatcacatagcgaagaaaaccaagcttctcttttcgtggctgttgcggctgtttgtaaggtagaaaatccagcaccatggctgtccagcaggcatagccacaccaaccgcgcccaaaaaacaatggaccaaatattttcgccacagcataatggatagttgccgcttcaaaaacgcctaagaacagataataccagaatccctcaatctgcatattttcatgggaaatcacaccgagatacaacaacatatagcttcccaccgccaattgtatgaaatgtctggcatactgttttccggcggtaaatagtgctgttcccagtccaaggcagcctcctatgtagctaaaatttaatagataaaatagatttttcttaacaagccacaatgtaactgccactatctcaaatagcagaaatagcaaaattgatggcacatatttgcgaaacttgtttcttttaattgcttctttttgtgcgggtttgctctgaactcttttatctttattcatagaggcctccttatcatttagctttcattcttgattatacattccgccccatggtttcagcaagtgaggaaatagaaaactctggctttaatgaactatgagccaaagagtaaaggacttgccctaatcttttattatcagcttcaaactctattttcatacgatgactgtacttatagcctttaaatcttcgcttccagctcttatctctgtcctgatagctttcatattctgtatcgacattaaaatatactgttttaaggtcttttctctgaaagccaagtttttcaaacaaatccttgaggagctctgtatcttctgttgaccttcggagagtatcttcatattctttgcaaagttcttccttgctgacatataaccggatcatatccggctttactgctattttaccttttcccgtaactttaattgttctcattatctttgctcttccttttaaaaccgctatcatcttctttgtcatctgaatatacttaccaaatggattaatcacaattccattaatcttttccccttcttctcatctgaatcagcatttttatctctaccaagagtatgatcaaactcatcaagaacatccgtcatcaagccttcatcaatccggcttctacactctgcaatcaatacagccggaattccataaaatgcttctgcaatactgcctgtgatagcaccaagcgtgtcagtatctccacctagtgatactgcattccgtatggcatcctcaaaatctttggattccagaaatgcaataattgcctccggtactgttctctgacaagtctcatccatatgatatcccggtctgatctcatcaagtgttctatcaagattgtaatgaaactccctctcgatgtattctttaatttcttcttttgaaaatccattcctagccatgtatattgcactggctgttgcttctgcacccttaatgccttccggatgattatgtgtcacatttgctgtcgctcttgctacctctcttgttctttccagcgaatcataaagccatcccgccgctgacactctcatggcggatccattcccataacttccgtatggctctgggttgctttctctaagccaatacctgaatcttccaccataacctgcatatggatatctttttccccaatcctgcatgttagttactagcgcctcttctatttcctttactgtagcttccgttccgactgcaagaagagcttctccaactgctattgtcataacagaatcatctgtaaagtcacagcctttagtaaacaaatcgaattcctttgttttatttcctctgtcaaactcaaatggacttcctataatatctcctaaaattgctccgtacatatatgcctccaatctccggattgctccggcagctctttttctttgttacaatataagtatagttgagcggcatctttatatggtcgctgtctgggcgacactttttaggacaaaagcaaacgccgatactacaagtatcgacgtaacatatgccaatcaatatttacttgtaacctctttatactcccaatatttcattcgtatacttaaacaaagtcacattcaactgcataatatcatactgcttatcaatgatagccttctgtacaatcagatccaccttactgcttggactaaatgcccaatctgctctggcaagtaaatcttttgactgttccaggtcaagccgcagtgcgatacagagtgccatcacagttttcttctttggatgatagttctggtcacactgaatctttgaaaaatgtttcctgtcaagatttgcccgtttccacacatctttattatcaagatgtgcttcgtcaatcagttcaaataatttatcatgaaaggaagctcctatattggccagctggtcttccaatgaaatattttctaacggcatgagtaactctgtcatgcctgtatctgtcattttctcaagtagatagttgtcttcttctctttgaagcatttcttcattgaaatcttcttctgccaattcttttatacgagtacttcttctgctccttatcgggtactcttttctatggatttctctgacgtaattagcatctatataagaatcaatatccccaacaatctgaccggacagctgaaaagaccttttatcaaacactaccagtatgatttccatttcattttcagtaagaaactggctgaatactgacacagcaatctgtaatgccttgttcttcggaaatccatatactcctgtcgaaatcaggggaaatgctatactctcacactcaagtttcaatgctttctgtaacgattttcgataacaattctcaaggatttcaaattcatgatgctttccgtctgtccataccggtcctactgtatgaataatatattttgcctttaagttgtatgcaccggtaacagcaatatcacctcttgcaattttgccgatacctgctctttcggcaagaagctgttcttttcctgccgcctcatatatggctaaatctgtaccgcttgcacatatcggattcgggttggcagtatttacaatcacatctgctttaacttttgttatatcgttacggacaatcttaaatggcatcgtgacacctcctagtattacaactctgtataagatatctgatattcaaacaaccgcattctcttatcattatgccctcttaaaataagttcctttgtcagattgttcaaacaaataatcccatatacttttttacctttgaatttttcacttttctcaaaccattcgaggtactgaaccgtctgttcataagcatcatcatagccactgtccttcttcaattcgacaacatacaaatttccttgattatcctcacataataaatcaagtcttccaactggaataatatattgtctgccatactcacctttacgtttatactctttaaggttcataccaaatactgacatatcactttctattcttgcagtaagctcattttctaacaacttttcattagagaactgctgtcgttttatcccaatgtctattgtaactttttcagcactgtcagtatcatcaatatctgattcaactgctacatcacacttcttcaaccttgcattgtgattatccagctttttcactctgtcacgaataactttagcgacattaaatcgggttactaccgtatcgtatgcgttttttgttctccttttctgctaaaaataaaaaaacacagataagatacatcaagccttgtttgtgtcatttttcggggcgaaaataaggtaaatatccctttctaagcctttccgaaaatcgcataaggtatttgtactaacctgtggttatgtattgaattataggttttttgtatataagttggaagtgaaactcgtgttatcagagagttatcagtctcaaattcgtgataagcatcaaaatgagaaataatataatcaccacgagtaactggcaaaatagagagttcattatccgcaaaaatccttggtaaattaattgtatggtcaaacttcgccatcagtcgtggctctcgtacttcctttatctgctttgctgagatttgaaattgcccagttctctcaatatgtcctaatatatcgtacttctcaaatagtttttcccacgctatgtcattaagacttttttgacgatcacttataattacgcaccaccacttcgtcaacatctccacgctttgaagcgactgaattaacagcacgtttcgctttaacaatggttatgttgtaagctgcatattgctccaatataaattctgttgcagaatttgaaagcataaactttatgccacgagcatttaaatcatcacaacactctctcagtcttatttgatcttctcgtgaaaatccacctctcgagtatccggtaaaacttgcagtttcagaaacaggatcataagggggatcaagatacacaaaagcaccccttggaacatttttcaatacttcggcatagtccattgtcgtcatacgaatatcagcagaattaaaatatgcactaacagccctcaatacaggtgcattcacaatattaggatttcggtaattaccaaacggagaattaaactcacctgcattatttacacgatacaatccattaaaacaagttttattcaaatataatactcgagcagctttttgaacatcagtcaatgtcaaataataatccttattgcgatctcagtctctaactgcatagaactgttcagctgtattttcaaatttctctaactcttcaatcagttcatcaacattttctttgataaccgtatatacacgaattaattctggatttatatcgtttatatatgccgtattaggctgaagatgaaacaacaatgcaccgccaccaacaaatggctcacagtatgttgtaattttttttggtaacagtgggcgaaaagtatccaataattgtctcttcccacctacccattttagaacaggggctaccagtttattctttctcattttgccaacccctttctttgcttcgttttttacataaaaattcattttaaattataccacctttttgctaaaattcaattacctgctactgtcaaatagggttgtttcatgaagctttcaccctatgcaggcatgggtagatgttgaagatagcttagatgtatggtaaattaatggtgaatacttctagtggattaaggatgaatatgtggtagaataacccatatggtagacttgtttaagagactaccatatcggaatttacgcgaggtgcattgatgaaacaactattgaaaatagatttacaaaattatgaaaattgcgatagcgtatttagtagaccatctgtaagaggaattattctcaaagataatagcaaaattacacttgtttacagtgagaaggaaaaatattacaaatttccaggtggagggattcacaaggatgaaataagaaagaagctcttattcgggaggttagggaagaggttgggttaactgttattccggaatctatatgtgaatttggaagtgtaatgcgtaggcaaaaaagcaacgtttcgccaaatacaatttttgagcaggaaaatttttactatatgtgtaaaacaaaaaatcggattgtagaccaagacttagatgattatgaagcagaagcaggatttacgcttaggtttgttagcttggatgaggcaattcgtgttaattcagcatataaaagtgaagattattttaatgaaatcatgattatgagagaaacaaaagtgttacagatgattaaagacgcaattcactgaaatcaaataaaaagattgtagctgttcagagcagaccgaatcacttgctgatgaggtcgtaagaacatgattcgtaaaatttaaaaggacataggtaaaatgagcttaataaaaaatgatataccaattttagaatatgacacaaacagcaaggctgttattatgccaggacacagtacgaattttcattttccggagagagcagtaatgctgtttatggaaacagagattgacgattatgctatgacaaataaatgcgagattatcggacagtttattagtatcacaaaagtctttcctgtatataaaacggtacataatggtgttgagttggcaatttgtcaagctcctttaggtggggctgcttccacacaaattatggaacagctgattgcgggtggtgttaaaaaggttatagccacaggctgttgtggtgctttagttgcagataacgagggggatttttatatccctacctcagcactacggcaagaaggtacatcttatcattatctaccaccttcacgagaagtcatgcttaatcaatcagcaataaatgcgattgagaaaatcttaatcaatcacaaatacaactatcaaaaatgcaaaacatggacgacagacggattttatcgtgaaacaaaagaaatggtggaatatcgcaaagaggaaggtttttctgttgtagaaatggagtgtgcttctctggctgcttgcgcagagttccgaaatataattttcggtcagttattgtttacggcagattcacttgcaaatatagaatcacacgataccagaaattggggtaataatacttttgcgttagctatgaatttggcaatggacgctgtaacggaggtgcagtaatgcaaacagaaaaagaaatgtctgtattggaagcgacaaaatcgggcatgattttaggaattttttgaaattattttttgaagtgtaaaaagacataaaaaaagatgccaggattcctcctgacaccgtagtaactgtgccaacttcgtgcccagtgggcacaaggttggttcatctcatcatatactgttgtaatttgaactaccccaaccgactaacgtcggatggggattcctacgggctttcgcccgatacccactcgttcagctcatgggtgttccaacagagaacaaacccgttttcaggaatgtttttgtatgttggcgtaagtcagatattcccgtccatccagctccctgcccactcattcaactgactggtacaaagtgactggtaagaatatccgaatatttcttctatttctatatttttatatttcgctttttcttttttctatcttcttttatacatactcatatcgattattttgcgtccattttttcatttccgatgcaatgctttttaatgttcctttttttctttcttctaagacttcataaggcagttcccggtaaaaactatggggcgaaactccacgaaatgcttttgttaactgtttccatgctggaatgatactcacaatatcggttccattttttagtttttcttttgccttttctggtaataacacaagtaaccgctcatccggtaacagtttttcccgaattcccattccttttaatccaatcgtatacgatgctgcttcatgaatggaaagtccaaatggtcttaaatacaaaaacttccccatttggctggtataagccggattcattttatagattccaaaactttgtttataggcttgattttccaaacaggtcgtcatttttcggtaagcaaacaaagaagcatgtcgattctttttcttacatccatacttcattccgtgttttgcaagcgtggtatccaaatcttccataataagcggtttcttccgttcggcgcaataacgtcctacctttgccatcactcttccgatttcttctgaaatctgcccttttgttttcaattccggtgaaaaacgaatgactgtcccacccagacggtttcctttttcatctaattctgaaactgctacatggtcataattcaaatcaatcgaaacacagccttttttcaaagattcattgcaatatttattttccagtaaaagcgtcaccgatacaatcagatatcttcgaccagttttctctcgtttcaactgaaaattataacaaatcgcttttcgttcctgtttttttgcctgaagcatttcttcccaaagttcctgttgccttgcaagatggaactgtttaaataccgtttcttttccatccatacattttacaatcaaatttctttcttcttttctgaccagaaagttacagttttttgaagtatgacgtcccggaaggctcattgaagcatggcgggattcaaagaattcctgtttccactgttcacgatcgacttttggattgtctttcttttgatattgttttcttccaccaaatacaattctcttcggtggaaacttttttaaccattccagcctttgaatggctcttttcttagaagattccattaatgcaattcttgttttcaatcgacgaatggaacgttctatttttctttcgtattcttcggctggaaagtaggttccatttggaagaaaaatttggtttcgttccattgtaattcgacactttggataaggacgctcccagattccgcttttaaaataagttcgcagagaagatttgattccctgcttcttttccaattcttcctgtgttcgttttatcttttgattccgtgtctcaatatctttttcttttgttctctgatacaatcggttcaattccttttgagaagaaagaacagaagacgcataagtatagatggcacaattataatagtccgttgttccatagttccttttcagccaggagctgtaggttccttctaataacggacctctttttaaaaaggatttgtcatacaagcagttatagagcttgattttgatatgattaaatcgttccatcgtctgaatcaaagactctacgttctggatttcatcctcatccagataataccgcttatctgcatttatcgttctggttaactgcatgaaaacactccttttctcaaaacggtttgtcggttaaaaatataacaataattgaaacaaccctttatttatagtataattatagcacgaatcaagccgttttacaacatcggttattttaaagaaaggagaaatttatggacaacaaaacttataccagaaatgctcattccatctgctgtctgacctatcatgctgtttttgtcattaaatatcgaagaaaagtaatcactccagaaatccttgcttttatgcgtagtcacacagattacttaatttcacagcgttatcatggaaaacttttggaatttaatggtgaagaagaccacctccatatcctatttgaacttccgccatccgctgcaccttctgttattatctgtaatttaaagactcagctttcaaaggaagtccgaaaacgcttctgggaacaaattcacaatcaattatggaaagattctttttggagtgacagttacttcttatcgacaactggcggtgcaaatttggaagtattagaacaatatattcaacaacaaggaatcgaaaaacaaaaacggaaatacgttcatcacaagaaaaaatgagcattcatccccaaccgactcgtcggatggggttttctgctctatagtagataaacgccactcatctttattacttacaatgctttttattagtattttagttctttgataatgtacagtatcatctatcacaatacggataatacccacaggagtattggttcgttgcgactacgaaaatgatacaattaaacgatgcaccccctgtgaacacccctacacaaaaaaagaacgccagaatcttatccaacgttctcttcattttcactttctcaagtcacatgatgctatcacatacatgtataaataaattgtacctctgcatttaactgaaacaatctctgatcttatttgaaatatcagaatcaacaaagcctttctgtgccatatcatcaagtatcccacacgctttgtcatgtgacaaacccttcttataaggtctgtcttcagtaagtgcctgataaatatcaatgcaagccataatacgctctggtttatttaattcatcagcagtttttccaaaaggatatccttttccatttaacttttcatgatgaagagccgcccagtctcgtatttcctcgaaatcatctatccctgacaaaatataataggtatatactgcatgatgtttcatcgttttaaattcttcatcggttaatttttctggtttttccagaatctcattcccgattgcgacctttcctatgtcatgtaaagctccggcaatatacattttctgacagatatcctcatcaaatcccatgaaccttgatattttttccgcaacacccattgagtggttacttgtaaagggtgatttatagtccacaatatgggcaaaaagatctgcaatagctttaatctgtgcaaaattaagttccagctttattctgggtactttcttccacaacatcgtatccagggtttcattatcaatcatatgaattttttcatctgaaaaagcattaaaaaaaacttccacgcagaaggaatcaaacaatttatcttttgactttattacaaattcttctgttcttttccactcatccgaatctgatttcatagatcggcaaaatatatctatcgtatcacacatatggataatccttgcaaaaaacggtacttcattccattgttttccaaaaggttcacttccatcagcgttttcatggggggggtacagtatgacattagatacatcattatgaaacggtatatttttcagaattttttctcctatggtacaatgccttcccagcttcgtcaccccgttacgtaaagcgtcattttgaagctcttcctgaatatattgtgccactgcattgtcgtgcagcaatgcacactctgccagatcctgcaggctttgaccctgtatacccatttttttcagcagtacaaaccgccatatatgccacacgtttagaatgattgtttgttactttaatcagctctgcctctacacagtccaatgcatatgagcaggctgctaataaccccagcacatcaaatttcatttttgatcttgtctcctcctttgttctgttttctgagaaatctggaatatgcttaccatgacagatttctcagcctcggatcaataaaagcatatgttttgtcttttctttaatttttccatgaccgttggatattttttataatctgtgtgaggtaaggcctgggcagctaccatctgttccagaaaatcatccacttccgcaaattgtatataagtcatttcttccagtatctgatcaatatctgcaagaagttctttgttcagcaaaagcttttgtgctccttccagcgaagaatttccagcattgatcatcttctcccgttccatgtcaggatacatcccaatggtaatggctgattccacagatacatattttccaaaagagccggctacataaaatcgatctgcctgattcagttcaagtccagattcccggagcatgatctcaaccattatatgtgctgcggctttggtaagaataaattcgtcgatatctttctgataaaaatacagacccggagcatattctatgcaaagctgaccttctcgtttctgaataagattcgttttttcaggagaaaacttaccacgaatatctatccagccttctaaaaaaagttccgcaatcagatcgacaataccggaaccgcagatacccttagggctaatttttcctgaagagttaccaattacatgaacatggatttttccacctcttatcctcacgctgtccactgctccggcatctgccctcatcccggtgtgtactacaccgccttccaatgcaggccccgccgcaccggcgccgcaaagaagaaaatctttatttcctatcacaagttcaccgttggttccaatgtcaaagaaaacactgattccatcctttttatataattccgtttcaatcattccactgatgatgtcaccacccagataattagacttcgccggataacaatatacataaccattcagcggaatgtccagatcttttgccggctggaatcccggacggtctgcatgaacagcatgtggcgtataaaagacacagaaagcatctattcccaaaagaaagtggatcatggtggtattgcctgctactaccatagacagacattttcgtgacaccggatgctttacatccagcttatccatgcactctataatagactcaactgtagcaagccgtatttcttccagttttttcctgtcatctttgcagaaaaaaatacgtgataaaatatcggttccccactgaatctgtttattaaagcagctctcttctcccaatatctcaccactattacaatctaaaagtctcaccactaccgttgtacttccaagatccacagccagcccataatgctgtctggctgtatctccgctttctatatcaaccagctcccatttttctccattccaggaaagcgaaacggttattttccaacctgcacgatcaagtaatggatatagttgtctcaacatgcgaaccggaatatgaacctcctctttcacgccctccgcggataaagcttccagaatgcgctgctggtctgaacgctgatcctcttcggttggaacagaaagatcaagatataattttcggctaagacctctcatagtattcatctccctacaatttgtgcattttttattctgtaaaaaaagaaggtcatttgctgtaacatgccttttcatttcatatacagcatttttcacaagatctttctgaattgtatttcttctgttagtcatttgccctccttattaggatttattcttaattagaagtatatatcagaagttttaaaatatcaatataaaattagtaataattactattattgaaatattagcactttgtaaatgtccctttttcgcacaatcttattccataatttttcgttcaaaaacatattctatttcagatgataaatctcttctaaaattgtatccaagtctgtcaaacgtttgtacgtctgcaggattttcaatttctttttctgccatatatctgaccatctcaccacgagccatcttagcatatgtaccttttgttaccagtttatcccctgattgttcacaaaacgtaaccgtaatatatttgtctttatctgataaatatttttctatacatttcgagtattcttttgatgcaagattaatgataatcctgctgtcatcaagcactgaacgatataatcttttaccacaatagtcatatagatttttggtatcttctatttcagctttcgccttcatctccaggcgatgccttctttcatcagcataatcattgtatcaggataaagttcacaaagtatccgcaatacattcccataagttcatgtcattattgaaattgtacatatttcagtatgaaaagttcaccattcaaattctgattattatttctccacatactcttctgccatatgtactgccatagcaccatctgccactgctgttactatctgacgaagtaactttgttctgacatctcctacagcataaacacccggaatactcgtttcagtgttttcacctgccacaatatatcctttattatccagctctatctgattatctaaaaaatctgttgtcggttttcttcctatactcacaaacaggccgtcacattctataatgttttcttctcctgtgactgtatctttcaaccgcacaccagtcaatcgttctccataaatcagttcatttactgtattgttccatcgaaactctatattttcagttttcatcagctggtcatggtagattttcgttgcacgtaatgtatctcttcgatgaacaatgatgactttcttagcaattcgacttaaaagaacagcatctgatacagcagaatttccaccaccaacaaccaccacgatcttatctttataaaacataccatcacaggaggcacaataagcaaccccatgacctatcaattctttttctttagcgagaccaagttctcttggatttgctccagtagcaatcactactgttttcccaatataaattcccgaactagtttctactctcttaagctttcctgttaaatccatattaaaaacttcagcatattcacttttagcgccaaatttttccgcctgtttttgcattttctctgccaatgaaaatccgtcaattccattttcaaaaccaggatagttatcaatctgccaggtcaatgacatctgaccacctgcagataatttttctaaaacaatggtatcaaatcctgctctggctgcgtataatgctgaagtataccctccaggtcctccccccacgataatcatatcgtaaacatgattttcattcatacagcagtcctccttttatttttccaatgcttcattaataaaattctctatcattatttttgattcaggtgcaacaatagaatctattgcctttccatttcgatataaaaccagcgtaggaatcacctcaatcttttcagcttctgcaatctgtggttcttcatcaatatttacttttccagcaacaagaatatcgctgtattcttcacttattttttcataagctgctccaattctacggcaataaccacaccaatgtgcccagaaatcaaccaaaaccggtttttccttatgaattaattgtccaaacttttctttatttatatttatagatgtcatatttttcaactccttctcctatttgaacttaatataccccaaataagtgcttgcttccgtgatgatatcacagaaaagataatttactttattacacttctttttatttctatttatggcatatgccagttatataattgacgcatctaaaaaaagcaagtatactatgttcgtaaaggagataacggttatgaacttcgaaaattgttttccactatggaatgacttaaatacagcacagaaaaaactaatttcagacaatttaatcacacgggatgtaaaaaaaggaacgatcattcacaatggaaacctggactgtactggattattactggttaaatccgggcagcttcgaacttacatactttcagatgaaggacgagagattacactttaccgtctgttcgatatggatatgtgtcttttatccgcctcatgtatcatgcggtctattcaatttgaagtaaccattgaagcagaaaaagatacggatctttggatcatccctgctgaaatctataagggcatcatgaaagaatctgctcctgtcgcaaactataccaatgagttaatggctacccgtttttctgatgtcatgtggctgattgaacagattatgtggaagagtttggataagcgtgttgcttcatttcttttagaagaaacatccattgaaggaacaaatgaactgaaaatcactcacgaaactatcgcaaaccatcttggttcccacagggaagttattactcgaatgcttcgatactttcaaggcgaaggactcgtcagactctctcgcggcaaaataacaatccttgattcgaaaagactggaaacactacaaagatcataaaacgtttttttctctaaagaatcctccatttatcagaattatgaaagtcattctaataaatgggggatctttttatactacaatcaaactataaaaatattttatttatttctaataatccataccacatgcatatgatctttcaatcagtgcatggtcattagccactgcatcataaaagcggaatccacctgaaaagttgtatgtttcatatccatttccttccaaaatacggcttgcaatataactgcgtagcccactctggcatatcaggtaaacaggctttcccttctcaacttcattgatacgttccctcagttcatctacaggaatgtttttaaatccattaatatggcccctgctaaattcacctactgttctcacatccagcaacacagcatttttatctttagaaatcttatccatatcttccaaatgccattgttttaaggttccttttgctatattgtctatcatgaatccggccatatttacaggatcctttgcagaggaatatggcggtgcatatgcgagatccaaatctttcaactgggttgccttcagtcctgcatgaattgctgttgccagcacatcaatacgtttatcaacaccttcatatccaataatctgagcaccaagcaaacgataagtctctttttcaaaaaccaccttcatggtcatcacttttccaccaggatagtaaccggcatgactcataggagaaagaattactgtatctacatctaaccctgactttttggcattggtttcattgatacctgtagtagctgctgtcatatcaaatactttgataacggagcttccctgactgcccaggtaacgactatcaccgccacaaatattatcagcgatgattctgccctgtttattggctggtcctgccaaagaaatcagcgcatcattacccgtaacataatgttttacctgaactgcatcacctgcagcataaatatccggtacagaggtttccattctgtcattcactacaatactttccttgatgccaagttccagaccggcttcttttgccaatactgtgtctggtatgactccgattgccagaactaccatatcagcctgaagggatggattatctttcaacaggacctccactccgttgtctttttctttaaatccttctactgtatagcccagtaccagttttatcccatgctttctcatttcattatggatcatggatgccatatccgggtcaaaagggttcatcagctgcttaggcctctggacaatcgtaacatccatgccaagctccctcaaattttctgccagttccagaccaataaaaccgccacctgccaatacagccgattttgaatgattcttatttatatattcctttatccgaaaagtgtcttctacagtacgaagtgtaaaaagtttatcaatacctactccgggaagtctcggctgtgttggctttgcacctggagagaggatcagcttatcatatttttcttcaaatatctcaccattctctaaatttttcactgaaaccgttttacgttccggatgtatggagataacttcatgatgaattttcatgttaatacggaagcgtttaaaaaaactctctggtgtctgtagtgtaagttcttccgggtctgtgatcacgtctccaatataatatggaagtccacaatttgcataggatatgtatccggatctttcaaacacagtaatttcagcatgttcattcagtctgcgtattcttgctgcggctgtagctcctccggctacacctcctacaattattaccttcatcttatttttccacctttcctgagtaagctgcaatgccaccgatattatttactttagaatatcccattcgttgcagtatcccagttgcctggcggcttcgtgaaccggaataacagtatacaaacagtgggatatccttattcttcgctacagaagcaatattgtcaagttgctgcaacggcacatttttactttctggtatatgtccttcctgatattcctgcggtgtacgtacatccagcagaactgcatcatcagtccttttatattcttctatgccttgattaatattcgactgtttaaagagatcaaaaaatcccattagcacacccccctaaagcatttctaaaatcgcattcttaggtctcgcccctgaaacctgctgtacaatcttcccattcttcataaccactaaagttggaatgctcataatactgaacttatttgccagttcaggctcttcatctacattaatctttccaactttaatatctctacgctcacttgcaatctcctctacaataggtactaccatacggcaaggcgcacaccaagatgcccaaaaatctaaaagaacgggtttatcggaattcagtacttcgttctgaaaattatttttattgatattaatagcagacattttacagtcctccttatctttttctttttgtagatttattatagtcttaatttcatttattttccgtgattacatcaccatacctcattaacttaacttcttgccataccatctacacttaatataacacctgtaatgtaactcgcctcatctgaagcaagaaacacaaacgcattggcaatatcttctggctgtccaagacgacgcaatggaattctttcaatcataggttcgataacttcctttggcacggccttcatcatatcagtttctgtaatcccaggtgcaacagcattaacacgaatacctttaggtcctagttctcttgctaatgatacagtcaatccgtttactgcaaacttcgatgccggataagcaaacccacttggctgtcccgaaatactcaccatggaagaagttgagagaatgacccccttgcctcttgacaccatacattctgctgctacacgagtagtattaaatactccttttacatttagatccatgactttatcaaaagtctcctctgtataatccataaatgaggtgttttctgaaatccctgcattatttaccagtatgtcgacacatccatatttttcagttgcctctttaaaagcctttctgacagactccatgcttgctagatttggactaattccagcaactattgcattgggatatttttcttttaatttatctacagcaacatctgccgattcctgtgaacttgctgccaacacaactgaagcaccttccttcaagaatttatcagctgtagcaaatcctataccacggcttccacccgtaatgattgcaactttatcttttaatctcatttagactacctccttacttagtttctaactacattataagcaaaaggtagattattttctgtgatatcatcacaaaatatcgcaataaaaaaccctgttgctcacgcaccagggttttggtttatccatccgtatttaacacaagattaggcttctattcaacttctgaaaactgatcttttccaacattacataatgggcattcaaaatcttccggaacatcctcccactttgttcctggtgcaataccaccttcaggataaccttcctcttcatcatattcccatccgcaaacgtcacatacatatttcattagtttattcctccttataaatatattaatacacagcatatattactgttgtatttgtgttgttctgtaaccttaatatgtataaatgcttttagcatttccataatccatgcaggttacaatatgcatatacttcttctacctgttcaccattgcaaagacaaaaatctgctaccggctcctgccctggatttaactgttttctgtatattccctggtttgtatttaatgtaatccactcaatgaaatgctcttcaagcattggatgttttgtctctccgaccacgacatgaacatgactgccttctatcgtatatacaggtacatgcttctcgacagcagcatctgtcactccggcttttaattcctgcataggttctccgcaacacattactggtacgccttgatcctttaccatttcaataatgtttccacaatgattgcatacagaatattttacttccatcttttttatcttcctatgtttaaaatttaaaatccaattgtttctataacttttttcaaagcatccaccgattcttaaactttaatgcttctttaccaactgatgcagaaccaacaaagccacagcctatcattactgctttttttaataatcactttcttctttgtaataatctccttctctttaatagttctcttcacgtatttcgaaataactctgtggatggttacatactggacatatctcaggtgcctttgttcctaccacaacatgtccacagttacggcattcccataccttaacttcactcttttcaaacacctgtgcagtttcaatattcttaagaagtgcacgatatctctcttcgtggtgcttctcaatctgtttattgttaataaataatagtaatgattactattattataataatcaatattactgattaccttttatttaaaataatcattcaatcatcattttttccgttcaaaaacatattctgcatctgatgacaaatcagagcggaatgaatagcctagtctatcaaatttcttaatatcctcaggattttcaattctgttttcagccatgaacctaaccatttcaccacgggccatcttagcatatgtaccttttgtcaccagtttatctcctgataactcacaaaatgtaatcgtaatgtatctatcctgtcgtgtcagatatttttctatgcacttagagtattctttcgatgccagattgattataatcctgctgttatcaatcactgagcggtataataaatctccccagtactcatacagattttttgtttctcctattccaaccttcgcctgcatttccaaacgataaggtgtcacaccatcccttggttttagcacaccataaaatgcagatattattcccaaatgattttgtacatactcgaactgactgtcctcaaacacggatggagccatatattgaaaagcaattccttcatatgataagacagctggggtaagtaaatgataaagatccatgttttccaatctattgaagttctgttctgtaattttgtcattacatttccagatagtcttcagttcttcttttgacttacttttcaaccaactttgtatctctgtcgtcttttcaataaattcaggcaatccatccggcgctatgctgtcagtatctgtaatcatctttttagcaggggataatattatcttcattaatctaattccttgagcatattttcaggatcatctgcagccttgactttatcatttgcctttataataatcccctgttcatcaataagatatgtggttcttactactcccatagagactttgccataatttttcttttctttccatacatcatatgcttcaataactttccgctctggatctgctaaaagtgtaaatgtcaatccatatttttcttcaaatctcttatgagaggatacagaatccttactgactccaagaataactgctcctttttcggtaaactgagggtatcgctcagaaaaaccacatgcctgtttcgtgcatcccgctgtattatccttgggatagaaatataaaatcactttttttcctgtataatccgataatctatgtattttcccattttgatctggcaactcaaaatccggtgccttaacccctacttccaacattatttatctctccctttctgtatctttctctttattcgcctttttcttcctattcccggtaatcattttatgacctgtatatatcgccattaccatacataacatagaacttaaagcaaagtatttgtgacttgatttttgctttttatatccagtgtaaaaagtcccaagcatcgtgatcaatgctcctactgaccaatatttatgtgctttcatgtaattcctccattttttcagtgtattcaattctaattatacgctaccatattcctatgtcaatttgataatagagcattcctataaattttttcaaaatatcattgtcaaaactatgtattgttatcctttaatttttctttgaaataattgacaaaaagcttgctttcaggagattactatttaatctcttttccatctatatatagttgaaatttatcaggattattgacaacatcatagtcctttccgtattctacaggtctatattcggctgtcattaccaattccccgtcttcaatatcctctttccttaaatagatgttcatatcaatgctcgtcgcatatcctctgtctgtggagaattttgtcgaatgaaaagagactttacaacttaaaattgaataaaaaggacaaaaaagaagagctgcttgctcttcccatatagtagtagtaaaataatatgtcatgccagcgcaatatattacctagaatatcgctataacaggaaaggggctgcattgtgacagcccctagtttacttcatcacgttgtctacattctgaatgaactcgttccctggtttattttagcatcggtctggattttgtttcataaagataaattttgccacagagcggtcgtatgttttaatgtgtccaaacagccagtcgattacatttttctgtacaagttcactgaaccgatctgtcggtccttcatactcctgaaggtattcatacagttcctgaattgtctttctaaactcttcatgtttttcataatgtttttcacgctctggataaccggatttttcctgaagcttttcctcttctttgaaatgaaagtcagtatattcatccagataatccagcattttgattgcttttactttgctgtcgccattttgacaggcagttacaaagttctggatacggtcgatcaattctttatgctgggtatcaattgtttcatttcctgttactaaattgtcatcaaaggtaatgtttaaatcgtaagtcataatttgacctccatttcttttatatgttctcttaggctcttttaatctctggcagtttcgtacctgcattttctgcttagtcttctacaggaacgaaaacatcttttcctaatccgcagattgggcatgtccagtcatctggaatatcctcaaatgcagtttctggatcgataccagcgtccggatctcctactgccggatcataaatatatccacatggttcacattcctattttatcatagtcattttcccttttcaatatcgatttatttttgttaccaagttcctagcaatttttctaacactttgtttcttgtatatttgtattatacatgataattatcctcttgtcaataatggtaattattattattattattttgcttagcataaactatatttgaattgcaaatttacatattgtatatatcatgggaatagttgaataaaaaaatgaactctattcattaaagacagagttgaaacctcaaacaaaaaataagcctgccatcatccgcagatttctccacagacaacaataggcttcctactatctcatcaactcattcacgattgtcaacgtgttgcgatgaatttcaccatacttaagatatgcatttataaaaatataaggcatccaagaatatcccagatgccctatcgaaaatgtgttttttatttatatagtcacttctattccacctcgaaaaatcaccctgcagctcttgtccttttcagctacaatctcatccagaaggccaccccaaagctcctctctgaactccacctgctccccatcaaggtcctgcagattcatgatgaagtttgtcaaaataccacgcttgtccttccgctcctgaatcatatcattcagttcgcctaacttctcttttttcttttcgtaaagattcctcaaagtatcttcctttttttgatactcttcctgatcctgcacaatccttgtattttcccggatgacactattgattttttctgtcaaaagctctatttccgcttccagcctttcctgctgcacttctaattcatccgtctggcaggtatcctcgatcagctccttcagattgtcaatgcactcttctttttcttctatcagcagattcagtgccttcataaaaatttcttttagttctgactctgaaaagtgtggagattcgcaaggttccttccccttctggtatttcttattgcaacgataaatgactctccgatatttgtcttgggaatgccacacctttgcaccataccagtttccacagcatccgcatctgaccttatttgcaaaaatatccgctccactgtatcgtcccatcttacttcttctaacaatttcagcctgcacataatcaaatactggcggcgggatgatcggtttgtgatgcccttctacataatactgtggaatctcaccttcgttcttcttccgcttcttctgaagaaaatctgtcgtgtactgcttttgaagaagtgcatcacctttatacttcttatttgtaataatggattttacagtgctggcataccattttctccttccagcggggcttgggattcctcttcgttccatttcctgagcaaccccataaaatgtttttccgctgataaacaaccggaagatcagccggatgattttcgcctcttcttcattgatttcaaaatccttatcatacccgaggaatctactgtaagccaccgctccttttccatcagcaaactgttttctcttgccccaagtggtattctcagaaatgctccggctttcttcctgtgcaaaggaactcatgatggtcaaaagcatctcacccttggcatccagtgtccagatgttctctttttcaaaatatacctctacacctttttccttcaattttcggatggtggaaagggaatctaccgtatttcgtgcaaatcgactgactgactttgtgataatcaaatcgatcttccctgcaagggcatcctctatcatctgcttaaagccatctctctttttggtattggttgcactgattccctcatcagaatacattccaacaaattcccaatcttcccggttctctatgtaggctttataataggccatctgagcttcataactggtagcctgttcatcccgatccgtggatactcgtgcatatccggctacccttcgtttccttatcgccacgactggttccaaattgaatctgtttaaggtagcagggattttcgttattttctttgccatgttgtcgcctccccatttttgaatctgaactcgatgctgtcacttcccacaaccagtttctctatatcccgtacaacggtttgctgatagggattttctaaaaccatttcggcagccttcagaagatcttcttccgttaaggcccgaaccttatcttcctggtaatgacgtttcgaacaataccatacttttttcccttggtagcccttatctctttggcatttttctccgcagctgcaccacaccttattggtaaatgcattctgtcctctcagtccgttgaactgccggatataatgtttaactcccctagaagtcaagaactcaagccgatcactatacactgtgacctgtttcacttccttcaaaaacttttcttcatcaagttctgaagttccaaaaatctgtgcactggcctttatcagttcctcttcccatattggtcggcagtcacaaaactttgcaccttttctttccctggtattgcaaacccatctctttcttgtagctgatgttcttcggctgactcccattccgcaatatccgcatttcatcctgccggagaacaccgtcagtttcggatttttatttgcctgccgctctgctctctgtgccctgatctgctgtgccttttttaaatcctcaactgataccagtggctcgaacatctcttctacatagaacatcggcaattctcccttgttcttcctacgcacatgattttctgtaaaaaagtttttttgaaggatcatggtccccgtataggaaatattggaaagaatatcctttaccgaagtctgctcgaatggtccgccctgttgcccggttacacctcttgcggcaagatcctttgcgatgccatatgctgactcccctgcaaggtatcttctgtaaatctcctgtacgctcacaccctgttccgggataatgcggaacatctcaactccgtcccaccgatatccgtatggtgctttatgtccattcggaattccctgttcaaatttctttcggatagcccatttgatattctcggagatgctccggctctcttcctgtgcaaaggaagccagcaacgtaagaaggaattctccatcatacgataatgtattgatctgttccctctcgaaataaactgcaactccgaggtctttcaaacgccggatggttcgcagggtatcaaccgtatctctggcaaatcggctgatactctttacaagcaccagatcaatctttccctgctcgcagtctgcaatcagtctgtggaactcctctcggttccgggtactcgttccgctgataccaagatctgcataaataccagaaaatttccattcaggatttctctgtatcaagtcgttgtagtaactgatctgtgcagaaaaggaacgctgctgttctttctcatctgtagaaacacgggcatatgccgctactctcagttttggcttcagttcaacctttttgggcttaatttttataattttcggcataaagccatctcctttcgcagtgacatattcgcgtactatccgcactatagcaagtccatttcggcccataatgtgccgattataggcgcgtatttctgccgcatttttgtgtcatatttctgatactgttcttcggtaataagccccttttccaacatccgacgtgctgcactcatggtcatctgatacacgacttcttttcttccctgttcccttgtcatacctcatcacctccgaatctggctttgatgtagcatgcgtgggaacagtacttccgatttgcatttccatacacggaaaactgtttcttacataccgggcagacaaagctataattggctttccgttttacctgatccagatgactgttccaccatttcatacggcatttatcggagcagaacttcttcggcttccttcccggtatcagctccatcacacttttgcagcacggacaatactgccttttcccctcagatgatgccagattggttgccactcctccaaggccatgcctccggcaatatgtcttgatggtgttttcactaatttcaagtatttgtgcgattctgccataaccatagccttcttctctgagttccctgatctgctgtctctgtctatcgtccatgtcctttacctccatcaaatctgaagggaacacttctgtatctctatcgttatagcttttcccttcactatcccatggacacgaaatcgttaaatgggcggtaagaaatttataaaatgtgcatcccccttccttttctcctgttttcgagcaaaaaaataggctctgcactacgacgtaccgtaatacaaagcctatttctttgattcttatttaattatcctcaaccatctcatcatcgacatacagatggaactgctctgtggcattcacaatatcatattctgcattccattcttccggtttgtattctacagtcatgatgggatctttttcccctatatcttcctttctggtataaacattcatatccagactggtaggatatccttcatcctcagaaaacttcatggattcaaatgaattttctttatacatctgaagcaaaagcctcgcaaatgcctctttatcctcaatcttatcctgatttgctacaacggtaagcatttcatcccggttcattttcatactgcctacaacatccgggactgctgcctctgccttaccacaagccgagcataccatgattgtcccaataatggtcataaccaccgcctgtttcctattatacttcttcacacgtttcctcctccatacacaacatctcaccaacaagatactggatcagttcttctggtgatggtttttcaccctcatagggtaccctcttccaatttttttgcacctcttcatccgaatccttcatccccacatcaatcactttctggatttctgaatagacctccaaagctgtggttccatgtttcttagcaactttctccattagttctttaaattccatttttctccacctgtagatttaattcttgttctatagaacaatatagcataatcaaacaggtattgaaacaaaaatcgttcgacatagttctacaagaatttacgaaagtacaaaaaaagaagggcttctcagccctccattacttgctattcctgcacatacgcttctattgcacgtatgactcttttttgctctttcggcggcagtttcatgatgcttgctgacagattgtttaccacaccatttacagactgtgccacaacgtccctcaaaagactatccgctgaaacatccagtgcatttgcgattgctacaaacgtatccagttttggtactttctgaccacgctcgatcacactgatatgtgtcggactcaaatctaccaatgcagccagctcttcctgtgtgagtcctttggtctctctggtttccttgatacgcagaccaacatctctcaagtccattgcaacacctccttcagaactatttataggtctaaagatattatatcggttacccatttcggtatacagaatctgcaaaactatttcttgttctaaagaactatatttgctgtaaaaaaacaaaaaaaaggctctgtactacgatgtaaaccgtaatacagagccatctttcttaatatttcgttgcaaaatccaaagagatccacccgttccgcttttccgtataagacttcaagagtccccatttcgttgctccagggccgtctgcctcatccacgatggtaaagaccccaatccctgtgaattttcccttcgcataattcgtaccaggacccttacgaatatagaggtccttaatctttacctgcacagtatacggtgtaaactgctgttttgctgcatacaccaccactccatttccatcaaatacagaatagcccggatgctcatccgcacatttcttcgcattagccagaatcttataggctccaagctggctctttgcatccgcccaggtcttgcggacacggtaatataccgtactggtctcctcttttgtattcgaatctgcgttatacttggtcagctcccacttttcaatgatttcacacaaccgctgcacataggtgctggaagttgcatatccaccatccttgatgatctgcgctgccttcttataattcgtacagcccttcagaccatgataccgaagcgtggagccgttctttgctccaagcaaatatgcggaatgatccgcaatggagtcctcgattgatggatactttcggaaatctgctgtgatggtgatcatctttccgttttcttcttcctgcgttttcttggtatagatgctctttccatcccaggaagaatttccccaggtattgccggacagggatttcttcataccaaaacagttgttggctccctgtgccagctcactctttccatagccggattccaaaatgaactgtgcaagggatacacaggccagctaatgtcattaacttaagaaaatttataaaataaaacagaaaaaggtcttgacaaatgtcagaaaaaatgtggcgaagcctccttgaatgaatacattttaggaggaattgctaatgaacttttacgctgattatgtccgcaacaaactcaacgctgccatttccagcatgtccagtcagatagaagattacgtcaaaaatcccgggcatgattttaccagaaatcggaagatgaactttacctcgacaataaactttctacttactatggaaggtggttcacttaactcagaattacataaatattttaattatgatctgaatcaaataacccgttctggtttcataaagcaaaggaacaaattgaaaccagataccatggaacatttatttcacaaatttcatgagcagatattatgtaacaaaaaataccaaggctatcagttacttgcctgtgatggttctgacttgaatatatttcgtgatccactaaatccacacacgtattttgctggtaaagaaggaacttttggttttaatcaactgcatcttaatgccttgtatgacctccaaagcaggcgatatgtcgatgctctgattcaggagccttatgaagaaaatgaatcctctgccatgattgaaatggttaaaaaactgactacaaatcagaagactatcattatggcagatcgtggatacgaaacttataacatttttgcaaatgttcaggaacgtggtctcttttatctgatccggattaaagatacctcgaaaaaaggcagcatttccggaagcctttccttgccggtatcctgtgaatttgacgaagaaatcgaactgattatgacccgtaaacaaaagtcttataaaacgaaaggttataaatatctctcaaattcatcgccatttgactttcttgattctgagaatttgttttatacacttcatctcagactcacacagtttcagctggaaaatggagtttatgaatgtatagccagcaacctggataaagaagaattcccacctgaaaagatcaaggaactttatcatatgcgatggggaatcgaaacttctttccgtgagctgaaatatacgattggcctgacaaatcttcactctaaaaatgtggaatatatctgtcaggaaatttacgcaaaactgatccagtataatttttgtgaaattatttcagcaaatatcatactggaagaaagaaaccgtaagtacacataccaattaaactacacaatggcaattcaaatatacaggcattatctgcgccagacattcgtaacgatagatgttgaaggtctgattaagaaagaactatcgccccaaagaccacaccgacaatatcagcgtcgagtaataaagaaacgatgggttagtttcgcataccgtataggataaaaaattattcaaatgaatatagctggcaaaaagcagacttttggtttgtttatttgttatgcgtaaatcttgtgatttttcaagaaagctaatctgaacacttattacaataatcgaaattttcttaagttagtgacattaccgtttcagggcccccttgcaatgaacatttatcgcatttcttggttttgcatatcccaaagcaaatgctacatcaattccagaaaataaaagtctgcctccatcttcaatcatacggatggaaccaaactccgaattgtgaaactctgtgattttataatccgtcttctccatcctcttctcctcctgcaccggcaagtaacatcaaaccattttcaatgattgtgctccgaataaactctgctacattcacggttaaataaccaagatattctgcaaggaaacctctatattcctcttctgtcagtaattcctccagtgcttccaaatgagctgtcactttagaagtctgttttccgccaagcagcctgcctaatatttctgtaaattcctctgtgtcacatgactcaaacatacataagatcatctccattgttgtttccaaaactaaacgatccattttcatttttgtcagctcttccattgttttcatggaagtcataagcgcatcacttatcatatgttctgaattgattcttccttctgaatcaactaatcctattgcaaataattctaaaaagtattttctcataaatcttgtcctcctatcgaaatggcatttcttgttcaagttcttctggtatatcgaatggaatcttcctcttctctgctggttgaaatccatcagattcttctttttttgttttggcttctgcaaattccacatcatccataatgacttcggtataataggatgcagttccagtctgttcatctttgatctgagagattactaactctccggaaagagcaatcttaattccattttcaagatatttctccacaaattctgcattatttccataagctgtgatcatcactacaaatgctttggttgtgcgatttctttttactactagtggaaacctggatactttggtttgtcccttttgcgtagatgccagcttagtttctggatctctggcaagcctacccattaaaacaatcgtattcatgcttcttgtccttcctttcctcctgcaacacctttccctggtatttcaaacaggataataatctatgcattttctgcacgaaaaaatgaggaatggagtcgaaccattccccacttgctacaggatttctcctgtaatataaataagaaaatctaagtattcgcatttgggctttgtctgtacatatacatctgatcgttatcattccagataacccggctgcaaaaatacagtcacagtctctgttttagcagaggtcctgtacctttcggtggtatcattattgcttcgctcttcccgtaggagtcttcgcctgcacgagccggattatctccggtaagcatgttcctcaagatgtatcagctccttcaattgtcaaggtgcaatcggaagaactgtctgaacctcttttatgtttgtgatttttggaaatcagaggattttcaatttgccttccatatactctgtattgggagcgacaaaatcggacatgattttagaaagtttttgaaattatttttttgaagtgtaaaaagacataaaaaaagatgccaggatttctcctgacaccatagttactgtgccaacttcgtgcccagtgggcacaaggttggtaatcaactattattgccatctatatttcaaataaaaaaacaccctcattccggtcattaatccaatccgaaaatgggtgttttctcatacctcaactctatgactatattctatcaatttttaagtacctctaatatttttcgatctataatttgaggtgtccggatttctcccgacacctcaacaactaacactacattttcaatcagactactttttattctttggctttattccccagaataccacattcataagtattacgatcaacagcacagcagccatagatacccagaatcccatattgagtccgagccattcacaggttccaaaaagtgtcatccataattctttccaattcattctttccacctcctagagcagttcgccataatagcggacatatgcttttttcaagcttgttgccagcatcatatacagcagaatacatgggatcagatatgcaaagtatgatgccggtaatgctatcagaccaagtgcagttccaaatggtgtgaacggaatcacagtcagaactgcaatacctgtcatggtaagcaatgttaccggtgctgatgcacggctctggataaacggaagctttggtgtgcgaatcatgtgaatgactaatgtctggctccacatagattctacaaaccatccagcctggaacattccgatataacgtgcctgcatagcagcaagctctgcaccgctgtaatgggctgccaaatcattgaacaggatgccctttgacacaaataacggacagaatacaaagtacatgaaaatataagttgtaaaatcaaaaatcgaacttgtaggtccaatccagatcataaagctacccacactggatgcatcccatttacgtggtattgcaataaattcctcatctacattgtcccaaggaatcgctgtacaggacagatcatagatcagattcaggaaaatcagatgtacactcatcattggaaggaaaggtaaaagtgcagaagcagctaatacagaaaacatatttccgaagttagaggaagctgtcatcttgatatatttgatcatattggcataagttttgcgtccttctatgattccctcttccagaaccatcagatctttttccagcaaaatgatatctgcggattcttttgccacatctaccgcagtatctacagaaattccgatatcggcagccttcatagccgcagcatcattgattccatcacccataaatcctacggtatgaccgttttccctgagaacggaaaccacgcgagctttctgatccggtgtaagctttgcaaatacctctgttgtctctactgcttttgcaagctggtcatctgtcatatgatccagatcagagcccagaagcatgttgcttacttcaagtcctacctgtttgcagattgtacgtgtcaccttatcattatcacctgtcaaaatctttgtcgttacgccgtgtactttcaatgcccggattgcatctgcagtagactcctttggtggatcaaggaatgccagatatccgattagtaccatctcacactcatcttttataccaaatgcacccactggagaaggattgcttttttgtgctatggcaagcacacggaatcctttgtcgttcagctcgtctaccgttttcagaatacgcatgcgaacttcttcagtaagtggcttcacagtgccatcacactccgcaaaagaacagatggatagcatttcttctacagctccttttgtcaccatctgtgtctttcccttcttatcctgtactaccgtagtcagacgacgacgtgtaaaatcaaatgggatctcatctaccttcacatagttttctgacagatcgaggagctttggatctgccgcctcttcttcctctgttctgtgaatgatcgccagatccatcaggttcttataacctgtctggaagtagctgtttaaatatgcatggcgcagtactcttgtatcatcttctccattcacattcaggtgatattccagcacaaccttatcctgtgtcaatgttcctgttttatctgtacaaagaatatcaatggcaccgaaattctggatggaattcagattcttaacaatcgtctgctttttgctcatggaaacggcaccttttgcaaggcaggttgttacgatcatcggcagcatctccggagtcagtccgacagctatggaaataccgaacagaaaggcatccagccagtctccctttgtgataccattgataaaaaataccagcggaaccatgaccagcataaaccggatcagaacccatgacactgcattcacgcctttggtaaagcttgtctccactgcttcacctgcaattgcagatgccatggaaccaaataaagtgcggtctcccgtgcagataaccactgctgttgcacttccggaaattacattgcttcccataaaagcaatattgctgtaatcggtgatgctttctttctgtgcacataccttcggtgtcttttctaccggttcactttcacctgttaagcttgcctgactgataaataagtctttggcatccagaatacggacatctgctgggatcatgtctcctgctgaaagatgtacgatatctcctaccactagatcgtccataggaatctcaattttttcctgttctcttcttgtaacggtacaagtagttgtgatcatggataacagtttttctgctgcatttccacttctggattcctgcacaaaacgaagcgtaccggagatcataaccatggtcagaatgatcaccactgttaatggatcaaaatcttccggtgaacttcctaacagagaaaaatatggaaaaaccatatctgtcatagtagaaacaactgccagacagaaaaggatcgctgtaaatggattgataaatgctcctgccagacgtttcacaagggattgtttcttctcatgtgttactttatttgatccatattttgtccggcttaccgctacattttcagcatccagtccacgaagtgttgtgtgcagactcttcaaaacctccttaatcggattggtggccgcatgttcgatgcgatggttctgctcgtcacggatcacagcctgctgtgctgcctgacgaacagccatacgattttctttcttattcattggtctttacctccttgttttgcaattattttttatagtatcgatcacttttctcgatataccaaagatcaaatcctgccacaataaaccatgcgatcatagcagtcacaaaccagtgattttcaaagcctgaccatagacctttcagcaaaaaaatcaaaccatttaatgcaatgacttcaccgatgttacggcaaagcggcacaattttgatcttttctttctcttcctgcggcatatttttccaggaagataaatgaatatgaccttttccacatgcaaacataaaaccgacaatcgtgaaaatgatgccaaaaaagatacaggttaaattcatggttttcttctcctttcattgattcatctcattctgagcttatttattttctgaagcctgataagcaatttcaccattgtaactgccaaaataatccaaacaacaacagatatttgataccagacctctatcaccaaaatttggtgagccgaaaatataaggctcacacaactgcatgctgcagtgaacaaaatataaagaaagaaaaaaattatccatctatcacatttgttttttttcaactacaacacctcccaacctgcactgattacttccggaagttccaatgcctgaccaacaatactttccagaacattacttttcggttttcctgcagaacaatacttcgctataatctcgactttatcccccactacatctccactttccagatgattcagatacaaagtcttactggaattactgttaatcagtaaaagtcttatatcctgttctgcaatttcctgacaaagtactgtgatgcagtattctttttcagattcatctccaacagcaatcggattcagctttcttgcaagcggacgcaggatcagatttgaaccaatcaaaatgcctgcagcggagactgccattgtaaacattcctgtgctggcaagaatgccaattgccgctgtacaccaaagtgttgctgctgtgttcattcctcttaccgtaccgctgtctttaaagatcacaccgctgcataggaatccaacaccggagataatgctgcttcctacacgaaacacctgatcggaaccataaagcattggaaataaagtaaaaaaacttgttcccatacagattagaacattaatccgtattcctgctggatgccctgttaactgcctttccagtccaataaaaaatccaagcaacacggataaggaaattcttaatacaaaatctgtgtataccatacataccgcctcccttcgactcctaaagaatacaaaaaaagcaaggagaatcacatgaccaaagtcttgcgatttccttgcgatttagcaagaattataaaaaatttggcggacttaaatcagcccgccagttttacaccttatcattaaatttatatccgatcccccaaatcgtaagtatatactttggttcatccggattcggttcgatcttctttcgcaattttcgaataaatgccataatattactgtcgtctaaaagatagttttcagaccataccgccttataaatctgctcctttgtaaatacttctcctctgttttcagccaggaaatacaggatatcaaactccttaggagtcagggaaaccgcttggtccatccttgtaacgctcctgcttttcggattgattactaattccccaattttcatttcatctgaaagattgagagatgcaatttctgaattctttacagtgctgagcagcaatgaatttacctctccactcaccatatcataaataccggaaagcagttctttcgcactgtcactatctggtggttctttgatcagcttttgaatgagccattcctgcaggacagaatccatggaaataacactgatattctttttcacgatgattctcctcctttcagatcagctcatgatatttcttctggtaaacaattttgactactgtagtcagaaacatatagagtaggactacgacaaataaaaacaggaaatacctgattggcaatttcgtcaatccaataacacctgcgcctttggtaaaagtaagtgcagtaaaggcaataattcctgcaaaggtcgtacaaacaaccggaatggaaggactgctctgtacaaatggtatcttccttgtccgaaggaaatgaaggatcaatacctgcgtccacatcgattctaaaaaccatcctgtctgaaataaagcaacatactgtgactgcatcactgaatctactatattcagatacgttgctccaccacacaacaccggacataaaatataatacaaaaataaaaatgtcacaatatcaaataatgaactgataggaccaaaaaacaacataaaccttcccagtgtctttccggaccagtctcttggagatagtgtttcttcctcatccacattatcccatggaaggataatacataaaatatcatataacagatttaataataatatctgcaaagatgtcattggcaaaaatggtaagaatgcactggcacaaacgatagaaaatatattgccaaaattggagcttgccgtgatcttaatgtatttgagcatattcgtaaatgtcttacgcccctctaaaattccctgctccaatacgcccagatccttttgaagtaacaccacatccgcagcatctttcgcagcatctaccgcagtatctactgaaataccaacattcgattcacaaagagccggaatatcattgattccatctccaaggaaacctaccgtatgtccattttgccttaatgcagatacaatccttactttctgtccgggtgtgagttcagcgaaaacatgaatattttctactgctttgccaagttcatcgtccgtcatctgatctaactcgacaccagtcaatatgatttcagaagagattccaactctccggcatatagaagccgctacgtcagcctgatcacctgttaatattttcggtgtcacctttagtttttttaaagtctccacagatgtcttagctgtttttttcggagcatcaaagaatgcaagatatcccatcaggatcatattattttcgtctgtcggtatgatctggtcctgtttctcaatctttttccgtgcaacagcaattactttcattccatcctgcagcatctcatccactacagaagctacgcttaaaattctgtccttttccatcggaaggatttcgccacgaaattccacatgactacaccgggacataatctggaaaatattacccttcataataagctggcaatctccatttttatctgtcaccagcgtactaacaaatttgcgggtataatcaaatgggatttcatcctctttctgatactgcgtgagaagaccagcaaaatgctgctcatgcccaggcatcgtctgacatgcaaggattgcgttatcaatcggattacatacaccagaatgataagcactatttaaaaaagcaaaatccaatacctgcccactttcgtttcccagcacatccatatagtattccaataggatactttcattggtcagtgttcctgttttatccatgcagagcacatccatgctgccaaacccttgcattgcattaatgtctttaatgattgtctgctttttactcatactcagactgccccttgcaaggcaggctgtgattaccatcggcagcatttccggcattaagccaacggcaacagacagagcaaacgcaaaggattccagccacctaccaccggtaatcttcaaaagtataaatacaataggaattaataccgcaataaaacgaagcatgacccaggcaattgagttggctcctttttgaaaagactgtttttcatctggttcttctttcgtaaaactgccatatagtgtgtcttttccgactgcaagcacaataccctcaccttttccactgatgaccgtcgttgccataaatgcaaggttttcaagccgagtcaaggattccgaattactgtaactcagtgcctgtgcatttttttccaggattgcactttcgcccgtgattgctgcctgggaaagaaatagatcacttactttggtgagtctcagatccgcaggaatgcgatcacctgccgcaagcagaacaatatctccaaccaccagttcctcagctggaatctctttcacttctcccgcacgccgtacggtaatgctttcatgtatcagctggtttagctgttttgatgcattctttgcacgaagttcctgaaccagacggattgttccgctaatcaaaatcattgaaaatatgataaccgcagtcgttgcatttctggcaaaattcgatacaagaaccacgtctgtagccagtgaaatgattccaataactaaaagaatgatattaaatggattgataaatgcacgccgcaggagtcgtaacatggtgtcatttcttctttgcgagaaactatttataccatacttcgccctcatcaattcaacctgtgattgtgacaggccttcccctgatatctctaattcctgatatatttgtgatacttctcgataagcatatttcttaatacaacaatcgatcagtgtagttttaggcatataggcttgcctcctttctcaataccgatatatttattttaacattatcttaaaaaaactccatgcttagattcttgcttttttcttgcgattacattgataatcaacttctacaccgcacctctttaaaaatcaataaagccggtactggatatcaaaatcctgcaccggctttatcgatttaattattctttagactcaaccgattggcatgcttgcaaacttgaagttaaatctttgttttaataccatgttatattgtcaatttctttcagtaaattttcccaatttcttttttcgttccatttaatttttccttcttcaatggaacctagctctatatcaaaacatttttcattgtcattaaagaatttccagttcaacccattggtatatataacttttccaaacgacttaatatgcccaagtaattgttcatcgttatcacctaaagctattgttggcatttttgcttctatacatccatatataacagcatcttgatctttttttctttcaagcaatacaaaatctggaaaacctgaaaggccataaaattttgctgaaatttcacttctttttcttgatgacacatctcgtatagataatttttgcttatttttagattctctaattacacttgcaattattgaatagagttcaatttccacacaagcattttgagcaaaagctaactcaatttcttctttaaaatcatcaaaatctcttgctattgacattatatcaccatcccatcaaatcccgaatttacgacaatatttctaatacagattttaccgtattttttagattcagtccatcttttaatcccagtcggtagaaaaactcttctgtatctgctccactactgaaaattgcgttacagtattccgtaatcacttcttcctgttctggggataacgtttccagtaattcctggtatttcttatctatctcacttaccggctctttatcctgatttaacttccattccgaatatgctttccccatatgctctgtaattgtcagattcacaaattcctgcacttcctctggtatggtactcgtagattcctgtttatctttctttttatcatttgatttttcaagtgtcgtgtcatcaatataacgaatgatttctcgaatatttgacttcatcgactgcagatatcctttcatcagcacagcaacttttctagcatccgatttttcgttttctttttccagcatataaaactcttccagttctttcaggatatccatccctgctttcatctgaaattccacctcaagcaaatcatccatcactttatataattcttccattgtttatttctgcctttccatatagtatcactatattttccacaatcatccaaaaataaagtcctgtaatccacattttacaacttcaatcactgcaacgatccccataccaatatgtggaaagagtacaaacactactgtcgtaatgatcgctgatttcattgtccagtccgtgctgattccaaatccaatactcaagacttctgtcacaacagagattccggctatcagatagcagaatcctgcagataatccaaccaggaataccaacacaatatttaccgctgcaagtaccagccaaacaggagctgcaataattcgaaatggcagttttatcataaatctcaacataattcttcctcctactttgtgcccagtgggcacaaggttattttaccatatctaccggatatgactatctctttttaaacttcgtgcccagtgggcacaaagttcttacccgtccggaatatccttgccccagtacatatcatgtcgaacttcagcatcataaaactgattgatcgttgctggggcattatacaacaccgtcaacatatactgccggatattcttcactttgcttgtactcctgtcaagactgaaaaacacatactggatgtgttcatacccgactttgagcaaacggctcttgaccacttgtgtaggcacagcttccccattgatctgttgatatggctttgtcgaacatattgcatccagcatcagctctaccagctcttctacttgtccagttccatagctctgacaaagaatctcatattcgatattgtcatgaattaactgtcgatactcatttctctcctgtatcctatctttccctttctcttgttcagatagatattgataagattcattctcactaaattcagtataattatattcagtattattacagtttgtttttgaaacttcttgaagtttgttttctaaacttcttgaagtttgtttttcaaactccttgaagtttgtttttgaaacttcttgaagtttatttttcaaacttcctgaagtttgtttttcaaacttctgtgtatttacgggcttttccggctctttttccgcatattcttctatttctgtctctgtattttcttttctctctgctacattttctagtgttttttctgaatcaaagattgctggctcatctggatattctgtcaggctaaaatttttcacgtaaataacatttgtttttccaagtccgatccgtctcttctcaatcaatccaatccctttttcctgatccagctctttcagacaattcaccgccttattcctgccacagttaagcatttccataatctcttccaccgaaaagaaaatatatgccctgtcctcttcgtcaaaccaccggttcttgatggacagtgacatccggtctaacatcagtccgtacagcacctttgcttcacaggagagatttttaaaatattcacttgtaaacagcagtttgggaatacgataaaaactgtacatatcgcattccattccttgaaaatagtggaatgttgctcttatactcatgacccatccctcccttcgtacttatcaatgattctgattgctccattcctccaaaagctgacatataacagtccgtatcttctgttcatcatactctggaggaaaatacttcttaatttcatcctgttttaatgttaccgttgttttctttttacgctctcctataaccaggagccgcacaatctcttttgtcagcgttttttcttctcgatgttgccttatttttttcgcctgttccagacttggatatttcccggtactctcatgcacttcctccaccatctcctgttctggaaccgcaagataggaaagctctacacctacctgcaatccaatcacatcacggtctactgcgtttaataggtcattcatcagatacgtgagccgaatatagcgatacacctgccttgcactgtcatttccgttctttccaatatctttcgcactgatacctcctgatgttccctgatgattcattgcttccatcttcatacggtatgcaaatgccttttcacttgggagtatattaggtctctgcagattgctgtctaccattgcccgaacagctgtatcctgatccatatttctgataataaccggaacctctttaagaccggcaagttgtgccgcatgtctccttctgtgaccggcgatgatttcatattcaccatcacccagcggtctgaccagtaatgctgtaagaattccctcttctttcacactttccaccagttccgccattgcctcatcatcatttacttgaaacggatggttctcgaaagaatgtaaatgctcaagtgaaacctgctggatatcgttcgtttcttctcctccgccaagtaattcatcataagatgtcagttttatcttcgatgcacttctacctttcatccaaaagcacctcctgtgtcatctgccaatatgcagccgctacttttccttttggatcatgctcaaatatgctgattccttccgcactgatctcagctgctcgtactgaaaatggaatactccgtggaaaaatcttgatctggtttccatatgtatcaaaaatcagatcagatatatctcttgcatagttcgttctattatccaccattgtgatcaatataccgccgattttcagttgtttgttaagctgtcttcgcacctttcctatcgtccgtatcagctgttccagaccctttacaggaagataagccgcctggacaggtataataaccgcatcgacactggcaagtgcattgatcgtcagcattccaagtgatggcatacagtcaatcaatatatagttgtattcttctctcattctttctatatattgttttaagacaagttccctactcataatatttacaagtgaaacttccattccagagagttcgatgtttgccggaatcaaatcaattccttcctggtgatgtaaaattcccagtgtattttcaaatggttcatcttctacaatctttgtcagaatagtagccagtgtgattggtaattcatctgggttatgatacccaagacttgctgtcatacttccctgcggatcattgtcaatcacaagcactttcttccctgcttttgcaagtccgactgccagattcacgcaacttgttgtcttgccaaccccgcctttttgtgaacacaatgccagcactttacaatccttcattactttctcttccatcctttttatcctcccataaataacttgaacctttcagcatccataatgctgcttccaaaaatgcaagataccgttctgtcatactatcaagagccggttctgaaataactggtttttcagacttcaaatcttttgccacatcctccaaaaccaaactcatttccttcatttctgaccggataatttcaattgtttctttctttccaacaacacatacatgattgtaaatgcatgatcggacgatataatcctgttttttcattccgctcactttcactcgttcttcaatcgttgctttttcataagaattcacccgaaaagaaatggtcgttgtgttgtgttttccatgtctgtcaccagccatcgcttattcctcctcttcctcatgtttcttatccagcaaacctgctaatttactctgcgtagacggatacagatgcgaatatgtattcaacgttgtttccaccttttcatgtccaaggcgttctgcaatctccaatggagccacccccatatcaaccagcatactggcatgggaatggcgaagatcatgaagtcgtatccgctttacaccagaccgctcaattccggtagccatacaatgttccatatgcgatttggtaaaccgaaaaagtctttcctttttcataattccatacaaatgactgcaatactcccggaattcctctgcaagaaagtccggcattgtaatcacacggatactctttggagttttcggctgcgtgatcatatcctttcctttcaatctctgataagatttattgattgatatggtcttctcttcaagattgatgtcattataagtaagggcaagcaattcaccgatacgcattccggtccagtacagcagaagaaatgccattcttgtttctggcttatcacttactgtctccagaaacgcattgaactcttcctgcatccagaaatccttcggttctcctttgctcttgccgatcgctcctgccttcctgcagggattatcttgcaggttataataccgcatggcataattgaaaattgcagtcagctggcagttcactgttttcagataagtaggagaatatccttttccattcttatctttatacgtcagcaactcattctgccatgcacggacgtctgccaccgtaatttcactgagaatcttcttttcaaaataaggcttgattttcaggtcaataatataccgcttcgtatacatagtgttttctctgagacggacatccatatctttgtaataaatctccaaaaaatttccaaattcaatatccacaccctggctctgctgttgtaggaaatctctttcccattccctagcttcacctttggtcctgaatcctcttttctgttttcttttccgatttccctgccagtctttgtaatagacctgtactttccagttttttccttctttgtaaacccccattactaatcctcgactttcatgccataaatcttttctgccaggaatttcgtagagatttttccagctactacaatatatccttttgccttcaattctttgttgtattctcgcatcagactatatgcataagtctttgaaactccaagaattgcacacacatcatccacatccatatacattttttcctgcaccatactcataccgctttatcctccttcaaatactgctcaacatgttccagaccatagatcttgtcctctacataacgggttggtacccgaccgagaatcacataaaagttcttgcttgccagatcggcattcattctttccaccacccggtaagcaaacgaaactgataatccaaagagttctgcaatgtcttccactgataaatacatttttctcttacgcatgaaaccattcctttccctcttcctgtggaatctcacaagtatcttccactccgtagaagcgcttcacaaaatactttgtcggaacttttcctctaagcgtcagatatccctgttcttccagttccttgttcagatttccgatgatctcataagccgatgtttgttttacttccagaagttcacatatatcggctgcctttaaaaataatttgttctgcataatcagtacctcctgtgttttgaatatttatctcttcatatactctgtactggcagatgcaaaatcggacatcatttttcgaaatttatcaaattttcttgttttttaattctccatcagtgtgattactgtgtcatggagtttaagctcatcgaaagtaaagaacctttctgtggtatctgttttctaaatgcaggcaacaaaaaaacagtctgccttgacgaaaatcacttcaatcaaaacaaactgttcttcatatttactctaattttattttatgagaataactgatttcacgaaatttgcaggtgaatctggaatataaacaagagaaaaaaataatttttaaactccatttgcactccatttggtcttttcgacaccccgcaaagcctttatttatgggcttttccgcgatttttcaagctactcaaattcaatcgttgctggtggttttccagtgcagtcatacatgacacgattgatgtgttttacttcatttacaattctgcttgttgtttttccgattacatcccacggaatttctgcgctttctgctgtcatgaaatcagtcgttgttaccgcacgcagtgcaattgcgtaatcataagttctttcatcacccataacacctacagaacgcatattggtaagcgctgcaaaatactgtccgatttctttatctaacccggcatttgcgatttcttcacgccagattgcatctgcatcctgtaccattttcactttctcagcggtaacttcaccgataatacgaattccaagacccggacctgggaatggctggcggaatacaagatattccggaataccaagttccagacctgctttacgaacttcatctttgaataagtcacgaagtggttcaataatttccttgaaatctacatattccggaagaccacctacattgtgatgagatttaataacagtagattcgccacctacaccactttctactacatccggataaattgttccttgtactaagaaatcaacagttccgattttctttgcttcttcttcaaatacacgaataaattcttcaccgatgattttacgttttttctctggttcttctacaccttttaatttaccatagaaacgttcctgagcattgacacggataaagtttaagttgtaaggtcctgtcggtccaaatacagcttctacttcatctccttcatttttacgaagcagaccatgatctacaaatacacaagttaactgatttccaactgcttttgataacataactgctgctacagaagagtccacaccgccagacagtgcgcaaagtacttttccatcgcctactttttcacggatagctttgatactttcttctacgaaagaatccatcttccagtcaccagaacattcacatacattgtatacaaagttagaaagcattgtctttccttcttttgtatggagtacttccggatggaactgtacggcatacaggttcttctctgtattttgaacagctgctaccggacagtcatcagtatgtgcaataatttcaaatcctggtgcagcttctgcaatatagtcattgtgactcatccagcagattgttttctcggatacattttcaaagagttttgttgactggttaaccgtaacttcgattttaccatattctcttacaggcgctgtctctactttcccgcctaataagtgcatcatcagctgcgcaccatagcagattccgagtacaggaattcccaattcaaaaatttcttttgtataagttggtgaatcctctaaatatacgctgtttggtcctccggtaaaaataattcccttcggctgcatttctttaattttttcgatatctgttttgtaagaaaaaatttcacaatatacgttgcattcacgcacacgtcttgcaattaactggttgtactgaccaccaaaatcaagtacaattacggtttctctcttcaacaaactctcctcctgttcttttttgaatctttttaatcagctttttcatgttttagaagtatgcattttaatttttgcattgtctaagtgctcatattataagccatctaactggattttacaagttctttcaaaaaaacacctttaatttacaatatccctaagcccgctttgcttttacatcggattcacatgcaccatacaatgttttacaagaggaaaatttttctcaactgcatcatgtactctctgcgctatttcatgcgcattttccagagaaagtgttttatctgctgcaatttcgatatccacataaatttttgcaccaaacaatctggtctggagcaaatcaatattttccactccggtctgacttgcaatcacttctctcattttctgaattgtcttttcatcacaagatttatccaccattttatccacggcatctttgaaaatatcgtaggctgctttcccaataaaaatacaaatcacaacacttgcaatcgggtctaaaatcggatatcccattcgagcacctaaaataccgataaatgcaccaacagaagataatgcatcggagcggtgatgccatgcatctgccataagtgctccagaattaattttcctcgcagctcctcttgtgtaccagtacatccattcttttgttgcaattgataccactgctgcaacaagcgcaaccaaaccaggagctttatttccttccactccttttataatctgttctaaaccattgattcctattccaattcctgttgcaaataaaatcactgccaaaataattgctgccacacattccattctgtcatgaccatactgatgatctttgtcagatttttttcttgaaatgttgattccaatcactgccacaactgtactaaatacatctgaagcagaatgcactgcatcagaaatcatagcaccggaatggcccaaaataccagctaataacttcagcaatgataaaacaagatttcctgcaattgtaactccggatactctcatcactatcttttttgatttttcatctgaaagctgttctaactgttctgcatccatttttatatcctccttcttctgtaaagcggacatttgcaatccacttcgctacttactcataaacgcagtcacttcgcaacctgtcacagtgggattagtgcagagtattttttgtttcataggatgctcctatgaaataaagaaaaaagcacctgtggaacaataagtaaactactgtcccacagatgcttttcattttcacctgctgtcacttttgtgacccggcacgtaaagatttttctctctttcctgcctgtttcgttttacgtcgccctcggcgtttttaagattttatgttattctatgacacgaaatacctgttagtcaatagaaacattcgttttatgtaacctcaaaaattcaggcatttatgacgcaaagtcagctgcaaaatcgtccccaaactcgaagattgagatagcactcacatcatttttatacaagagaagcatgtttccactttccgcccaggtaacggatagtaaaacagatagaccgaaacagccagtcaatcgtcattgcaacccatattccaaatactccccattttaaatacgagcctaaaatataactgaatccaattctaaacgtccacatggagacaatcgccagtatcatcgtatattttacatcggctgccgcacgcaaagtatttgcaagtgagaaagacaatggccagatagttacaacacagcagctatgataaatcaaaattcttcttgcatattcactggcttccgctgataatccataaacttttataatgaatggaagcagaagcaccaccaaaatattcattaaaatcaaacagatgtacgtcagcttcattaattttttcgtataatattttacctgttcaaaatctcccgctccaacacactgcgccgataccgtgagcattgcaaatccaattgacattccaggcagtaccgcaaacattgcaatattattagataccgcatttgctgcaatcgaagcagttccaaagctcgtcaccaggctgagtaccagaatttttccaagctgaaacatactgttttccagaccgttcgggattccaatatacaaaatctttttcaaaagattccagtctgtatgaaatgaaaatggatgaaagatatgaatctgacgactctgattatttaacagaaccaatataatcgctgccgctacacatcttgatactaaagttggaatagctactccctcaattcctctgtggcatccataaattaaaactgcatttcctccaagattaactgcattcataatcaatgaagtaatcatggcaatggttgaatttcccatggaacgaaaaatagctgcacctgcgttatatactgcaatcattgggattgacgcaaacacaattaaaaggtaaatattacagttatacataacatctgcgtcgattttaccaaaaataccatgcaggattacatttctaccaagatatcccaatgccataaccacaaccgatgctttcaccgtaaataacaacagctgattcgttgccttacatgcctcagcctctttttgttttccaataaactgaccggcaattactgcgccacccgtagctaatgccgtaaaaatattaataattaaaaccattactgtatcaattaacgaaactcccgatacggctgcttctcctacacttgctaccataatagaatctgccagtcctacaaatgcctgcagaaactggtcgataatcaatggtacaatcagttttttcaaatcctcatttgaaaaaaatcgcttcattttttcactcacactccatactattttgtacattttcagatgagtctattatactcttgcgatgagaaaaataaaagagtcggaacgttccagactcttttattctttataaacactgcaaaatcaaccatacattttcaaaatttcgcatctttaaatcctgcttttttatccaaaaataaaggtttccttgatattcccatctgtattcatcatcgtatccatctattgttcccacctgaaataaaagcatccaatccttacctttttcccaaatttcctctctttcctgctccggcacatcctgccagcctctgcctagataatatccccttgtaactccttcacattcttcttccattcgaccctgtaagacatccggattccctaacaattttatccttctgtatgcccattcgtaataatattccattccctcctcaaatatcggaactccacaggattgcagacattcatcatagtcgtctaaatcatcacacacaattccctctgttttttttaatttttctaaatccggaagtagctgttcatataccggcagactttcttcgttttttatccttacaattttcatttctgaaatgattgcatctttctctaattctgccggaaaatccattgcttcaagttcattttcatccggaaaataataaaccttcgcacaacctttatttgctggatcatatccataatccatcgaacgcatttcataaaagaaactaagaattccttgtttcggcaataattcttctttatcataaggtgcaacatcctttaaattaatctgtataataaatgataagggtctttctttcctgatatcttcaaaatctttcccttcataaactggccattcaaaatcttttggaacatccggctttcctccgattttagacgctctttttgcagcaccactttttagagtgtaattgattactatttctgttttcttattttgttttatcaactcacaaatcctatttttttctgcctgattcatcttatttcccccaaccttttatttttatgctcttatcttaccattctttcccttctctgcaaagaactatctttttttcttccaaaacaaaaaaagaaagccagattttctgactttcttaatttttacaatataatcagcagcagctgtcttactctctttctactgcttattcattactgattcattatttattatttcattctatgtttcattctttttccaacaatcactgctccaattcccacacagccacttattccaaacagagcaagccaaaattctattctgctgttatctcccgtctgtgcatttttagcagttgtactcttattcgcattacttgttgctgttttatttgcattatttgttgctgctttatttgctgtcttgtttgagttgtttgctgttgccttatttgtattatccgtcgttgtcttggtagatgaggtctgttttttctctagtgaagcaatggcatcttctattgcttttgccatcttatcgacttcttcctgctcggtgatattttttcctcgaactactgcttttactgctttttctactccagtaaagtctttatagtctgtttttttcagtgaatttgcttttttaactgcttcatctacttttgtataatctgcatctttatattccagagcgctaatggcatcttctattgcttttgccatcttatcgacttcttcctgctctgtaatatttttgcctcgaacaaccgcctgaactgctttttctactccgctaaaatctttataattttcttttttcagcgcatttgccttttcaattgcttcatctgcttttgtataatctgcatctttataagtcaatgtcagtgtctgggtatgcgtagcaatatctgcagtaaccgtaatttcaccgctaaaaggattacaattatccgcagttatttcaaccggatagattcctgcttctaattcagccaaacctgaagacacttcttctccatttactttaagaaccacatttgtcaattctgccggcactacagcaaaggaaacttcatacttaggttttggcagaaccggagtcttttcagaaacataattataatttccgccacctgccacaatttctttataaaatgcttctgttctcatagaatcaaatggtttcgctgtacctgctgctgcattttttccgcacgccaaaacattttctttctctgtataataattattcgtgaaaatacctgtacctgaaactgctccactaatgccaccaaaccggctatatggaacagtcgttaccgtatactgtgacaaatcaatatttccagcgaaataacagtggctgactgtcgtttcatttcccactgttcctacaattcctccaacatccgtaatcccttttccgagcggggttaatgttcctgttgaatagcagtttaaaatcttagaagttccactagtctgtccgacaattccaccaccatgacttgctgccagtatcatatttccagtatttacacaataacttacttctgtatctccagtagcatatcctaaaattccacctgcataaatacttcccatgtcacctgttatcgtaatatttcctttattttcgcagtaatttatctttgtattttctgcgtatccacacattccgataaatccataaatatatttcccattattctgaaatccaacttctgacacacagtcaaaaatagaagcattctctgcgtatcctgcaattgttccaaaaaaggtatattcactgtcgtctgctgtaacattaacgtttccttttactgtcagacttgaaatttccgccttttcaacgtatccaaaaaaacctccaactgctccttttccataactggaagaaaaatccagatttgaaatcacatgtccattcccataaaatttaccactgaaacagtgttcaatatctccggaagcattagcttgtcctatcggtgtccactccacacccgataaatctaaatctgcatcaagcactacgactgcatctgttttttcatcataatcacctgcattgactgcttttgcaaatttcagcaattcgtccacagaagtgattactgttttactgccctgttcttctccttctgcccataccgactctggcagtaataacaaacacattgccagcaccagaaacagtcctgtaatctttcttttcatacgcacctccgcttttccatttgtcagcttattccactctatctgaccaaatcatattgtttataatttatatcatacctttttttctgacaaatagcaatctattcgaagatgttttgagatttttcattccacactgtgtatcccgggagtttggcagtcgagtaattaaatgttcgtaaaaaaagagaggatgtgctctcctctctcttcccaatttttttatttttcctacatttctccaattttctctttccatatttcaaccagtctttccaccgaatatgctgcatttgccggactggttgatggaagtacttccgcttcaatcccaagctctttctgctgatattttcgaaaatacgttccggaagtttttccattacagaagattcgttttacattactatcttttacaatcgcttttaaatccgtcggaactacatttttaatgctgctgtcactggacccaataatatcacaactgtaaatagtatcccaaagcgctacatgatgccgatataacattgctttcttttcttcgatattctttggcaccggttcatttaacactgctgcgattactttccaaaatcgattctgcggatgcccataaaaaaacatctgctctctcgattttacagacgggagacttcctagtatcaaaatttctgattctttattataaagtgccggaaatggatgtgttacatgagtatattcctttgttactgctgcttttttgaccatctttctgtctcctcttctatttctgtccttctttttcatgcattaaaagatatttctctctcgttgcaattccaccacgaatatgccgttccgatttattcctgtccaatacctgacgtacttctaatcccaaagtaggattaatctgaatcagacgctcggtacagtctttatgtaccgtacttttgctgattccaaatttctttgcggcctgacgcacagttcctttgttttcaataatatagcatgcaatttccactgcccgttcttcgatataatctttcaacggataagcctccgaagacgctgtttttacagtgtatgccctggatttacagggtattctccaaactctattgtattattttcctattttccctgttccggattagcacccgtttttccattttcctgttccgtctgcgtatccagcatcattttaataatttctttatctgtctgatgcattccgacttttccgatgtatcccacacagctgattgtttcttctgtatcctctttaacaattccggtatatgctttatacgccttatgattcattgcaagataatgtgccatcattcccgcgtctatactggatgcaatttttgctgcacaggagatctttgcaccatcacagataattcccggaatatttgccaatgtattgtcaatcgttgctttaatctgtgcaacacttcctccacataaataagtgattgcggcagccgatgcacaagaagcagaaaccgcaccacaaaatgcagacagttttccaataaacattttttggtacgtggtcaaaagacctgaaaaaaccagtgcccgatacaattcatcatttctgtaatttttttctcttgcatacacgattacgggaacagaggatgcaattccctgatttccacttcctgaattaataataaccggcatatcacagccactcatccttgcctctgaagcggctgctgcataggctttcatacgagtcactactccgtctgcataactctcacgcagcactcttccaattccaagaccataatctccggaaatcccctcataagcaatatccatattatatcgaatctgtcgttcaatcatcggacgtactaaattcaatggcacttcatctgcaaactgtttgatattctccaaagtaagcacggaacggtctgtcagaccacctccggttgcttcgttctcatcaccgataaaaatcgtttctccatttttttctatttttgcaatattcgtatgtgaataacggatttcaaccattgctgaatctgctcctgctgacacttcaaccataaaatgcaatggaatatccgaatccagaaattcaacttcacaacgtttttgttccagcaattttttcgtctgcgctctctgttcctccgttaccttttctaaaacttccattttattttctgagtgacctgcaatagctcctaaaatacaggctgtttcgattcctgtcattcctcctgaatttggaatcgttacacaacgcacatttttaatcatatttcccgaacattttgccacaatatattccggttcacatcctaatatttctcttgcttttgcagaagcataagccagtgcaattggctctgtacatcccatcgccggtactaactcttcctgcagaatcgctaaatatttttcctgtaagttactgttcattgacgatttccccatctttctacatttttttctattgtaacatgataagataccaaggtcaaaagacatgatggggataaaccaccttttgactttggtatcttaagtaaagcggatattcgcctgactattatcttcttttttattctccgctccgtatccgttctacaacacttatacggcacattttttcacatgccagatacggtacgaaaagcacaatcaaaagcaaaaacggtatacagattagaattggaagtacagtaaatttccatgtaaaaaagaaaaatccggatgtataactttttattaaagtcatacttaaaatacttcccgcaagaactgctactatacttgtaaaaagcgcataatatccgccttcccacatcaacatctctcttaattgttttctggtcattcccactgattcgagcatggcaaattcctgtttccttgataaaattccggtcaaaatcgtatttacaaaatttaaaattccaatcaatgccaacacaaaacttagaaatccaccaacgattacaatcatattttgaagcgtcgcaaattctgcctccatcgttgattttgaagtataagttaaatcatcgttgatattcgtacaataattttccagccagctctctatctgtttttcatctttttttgatacattaaataatgttttcatcggctgtctgccttcaaagtaatttaaaaattctgaagagggaagaatataatttatctcaagtgaaaaatacatctgaaattctgccggataaggcatcgacacaagtgccatcacctcatactctttcgtaaacccattttctccagtcaacgtgattttgtctccaacatcgtaaatcggtttctcgccatcatccgattcgaattgattgaccacaatataatttccactcttgaatttctcccaatctaattcgccctgctcacattttaacttttcaaataccagctggtccaaaccatacatttttgctgtgatgctcccacgctctttatcggcgtctatttcctgtttcatgtcctcttcaccaatcgactgaatcatgtaagcaaaatttttcttccaatccttccagattctctcttccaatcgttctttttcccagtctgataacttctgttcccattcgctgtaatagacatttccgctttctttgattccatcctgttcccgtaattccgtcaaaaaatcactggtgactccatcttccgttctttctgaaagtgccggattatccgttgtcgcatccgttaccatataatcgcttacactcctgtttgatacatatttatccatatcaaatccctttagcaacgtacaaaccgtattaagcagaatcagacttaacgataaggaaaatacaaccaatactgctttttttcgatttcttttgatatttgccagcccaaaagcatgcatggtaagcttatgagttcttctctttttcccttttacctttgcatttacagagctttcggtcagcttcacagcttcgattggggaaatctttgctacgatacggcacggcttaatacagctgatttgaaccgtcaaaaaagaaaagactgccgaaccgataaaaatccatggatgaagcaccacatttgttccttctgtatcccccatacttaaattggcacagataatcggaagtaatcctgcacccacaaccgcacctaaaataagtccaatcggaattcctgcaagagaaagcagatttgcctgttttcttactatttttccaagctgtttttttgtcgttccaattgtctttaaaagtccataaaaccgaatgtctccaaacacattaatgtaaaaaatattataaataatcagatagccggaaaccagaataatgccaagcattacaacaataagtacaactgtttcagcgtctgccttcactccaagatatgcccagttcactcccgttgatttttcttcgaaaccaatccgcttatttaattcttccagctgttttttaagattaaacgaggtcttgaagttaaaatctaccatataacttcctgctatatctcctccatattgatagctctctgcagttggtgcaagctgattgaccagttttttcgaaacacacattacctgtgacatcgaaacacgatctcccttataccatccgcacaggataaattctttggaatatttctttcctcttacactaaaatcaaccgaaaatttctcaccgattttgcacggaacgcccaatgcctttaaggtcaaatcgcttgccacacattcattttctttcttcggcatgtgcccttcttccggataacaaaaactccattttgcctccaactcctcataataagccatttctgtgcgtactttaatcaaaggtttattctctgcatcagcaagtgcaattcgataagaaaccgattttaagcccttgtcttttgccactttttcatattctgattttgttaagtatttatatcctgcatgagcactgcctccgacctgccgcattgtagattcctgatttttttcaatcagacttcctccaatcgtaaacagcgcagtaaataaaacagaggttaatgcaatggctaaaattgcaattaaatttcgcttttttcttgcctttaaagacttcaatgcaatttgattgatcatctttttatttttcacgttcgacacagtctgcaccctctttctgatttggatttttgtccattatctgcaaggtctgttttccggacacaatttttccatcttcaatccgaatgatgcgatccgccatctgggcaatttcttcattgtgtgtaatcatcacaatcgtctgatgaaaccgctcactggtcactctcaaaagtccaagcacatcctgactggtcgctgaatcaagatttccggtcggctcatccgccaaaagaattgccggtttcgccgccagcgcccttgcaattgcaaccctttgctgttgtcctcccgaaagctgacttggaaggctttctaatttcttatttaatcccaaaagcccgatgacttctttaatataagctgtgtctactttgtctccatcaagctcaaccggaagtaccacattttcgtacacattcaagaccggaactaaattatagctttgaaatacaaaaccaatctttcttcttctgaaaatacagagtgcatctttttttaactgataaatttcttttccatctacaaatacctttccagaggttggctcatccaagccgccaaacagatgcaacagggtcgattttccagaacctgacgaaccgacaatcgcaacaaattctcctttttctacagataaatccacaccgtctaaggcttttactgtattttcatgatttccataatatttctttaagttctcgcattttaatacttccatctctcatcttcctttctgtttttcctaatttcttatctaatctcttttgttaatttcagtataacaaagaactctttcgagattctttcggaaatctaacagttttgaaagatttaagactcctgtcctaccttggaaggtaacataaaaatgtacttccttttcccacttctgaatttacttttataaatcctccctctttttgcaaaatctcccgcacaagatacagtccgattccaacgccttcttcctgctgtacttcttttgcccgataaaaccgcccaaatatctttggaatttcttcttctgaaatgccacgtcctctatcacttaccgcaatcacgcaccacatttcatacagcttggttgaaatcaggacttcacttcctgtcggactgtacttcaccgcattgtcgagcaaattataaagtgcttcttccgtccattttctatcaaaaacagcctctgcctcaaagtccatttctatctttatctgaatttcttttttctctgccttcttccgaatttcttctactgcactttcaagtagcggttttacctgacttttaaccggtaccacctctaaaatatttgtttctaatctggaaagtttcgttaacgcctgaattaaaaattccagtttctgtgcctgtgcctgaatctgtcccagcagttccgcttccataccgtcttcttccaactgttccgaaagcagttcactgtatagttttatgtttgccattggagttttggtctgatgagaaatatctgaaatcagccctttgatattagccttttctgtctctaaattctgctttgccattgcagaatcctgtaaaaaccgtttccactttgactctactttggaaagttcactttcatcatatttagactcttcaaattctccacggattccctcatcaagcatttgatttaaccgttcccagtttcttcttccccaaatcacttttttatcactcttctttcctccagatatagccctgaccgtatacggtctgtatatattttgtctcgccttctattttctttctcagccggttgattgtcacagacaacgcattttcatccacaaactcagcgccatcctgccacagacgttccatcaaaatttctcttgtcaaaatccgtccctgatttttcaaaaaaatctgaagcagtctctgttcatttctgcttaaacttaattcttcttctcctttaaaaaaacagagccgttcaaaatcaaatttcaaattctctatcacataataatttggcaaaattgactttatactctgattctcacgctgttcccgaatccggcgtttctgcacttcaatccttgcacgaagcaccgccagactaaatggtttggtaatataatcatctgcaccgagtgaaagccctgtcacctggtcgatttccaaatcattggcagttaaaagaatcaccggaactttcgatgattcttttacgaatgccaaaaaatcatatccgcttccatccggaagattcacatcaagaatgacaaggtctgcgttctcactttcccacatttcttctgccgtttttaaatcatgacagactgtgatttcgttttctttttcagaaagtgccaattcaattccctttgcaagtgccttgtcatcttccactatcataagtttcattttcttttttcctttttatttttcttgtaaaactgcggtaaagcggacattcgcaatccgcttcgctacttgctcatgaacgcagtcgctttgcgatctgtcagtgggagctttcaactcccactgacagaagcatccccctcacccgccgcttattgctctgcgcacttgaagcggtggaatgcttatctgcgttcaaaaagcagacttatgatttttccacaaatctgcttttcgattaccgtttatttttttcctgtgcttctatcatcagccagttctaattcaaactcctctccaaaaaactcctcatattcttctttgtattttttccatctctcctttcgttctaacgttatcttcttaatctcctccggggtgagacgattttcacgcatcggttcaccataaccgttcggataaggttcactatccggtaaactgtctgtataagcgctttctaaatcttcgccttctgcatctaaaatttcttcccaatcaattcccataacgactgtctccttttcgtaaaatcctccgtcttaattttgtttttatattctacggaaatatcacttttgtcaatagattttccaaatccaatggaagaatttatctctctttttcttgtgatcagtgtttcaaagcttccacagaatacaaaactgatttttgaggtatcaaactccattgccacctttcctttatcttccggaaagaatactttgtttccctcaatcatctttaacagctcattcttcattgcagcactgtagttatttccgcctgagccgtactttggttcacacagtttatcgaactcgtcgatgacgataatggcactttccgcctgttcccgtgacatatttgcaaaaatgtcacgaagtttaaacgcaccgctccagccttccattgtaagcattgtaccatcgacaatttggatattcggatataactggcttagtaccctccagatttcggtttttccgcatcctgtcggtccggcaaataatacattgcgcttctttccatgccagaattttgcgacgtcttcaatatcctttaacatgctgttatagacttcatccgtatagttatcataaagtcctgcttttgcatctttggtaaattgaactgccggattttctttttggatgattccacaacctctgatgagctcttctaaaaaatatttaacattgcggatatagctttcttctttcattctaactgacctcctgtgcttttttctgtattctcaaaattttctgtttctttttgttcttcttgatttcattataagcacaagtgccaaaattctcgtaaattttacgacaaaaagagcgctgttttaaacaaacaacgccctcaagatttttcattttttcgcaaaaccggtacgacaactccaccaactaaccacaacagaagcgccagagataataatcctgaaactaccattccaattaaccctaccattttcagattttctgtaaagctatatttgtctcctgctcacacagtgcaatcaatttcaaatcttcttccaatactccattcaattgcattctgacttcatccgaaaattcactccagcatttattaatttcttccgcataatacagattttcatgcaaaataatcaaaggagaatacccaaacagtgtatacaaagaatttaaaatcacagcatccggctctgcttccattcgttccagacgctggtaacgtttgatattaatatccagccgttccgccattttcatttgtgtcaaatcttctatttttcggatacttctccagatatttctatgttgttctttttcttcagcaagccggatatacttccacactctctgatttgcctctttccagttttctccgtgcatcagcataattccctgtctggtcagccagaataatgccttcattaattctatttttccatccgaagtcctgcaccgtttcatacagtcctccacgattcctgttttataatgcacaccggtaaccagataattgacatctcctccagccttttcaaacttcttcaaactgctgtatgaaatatattttgttccactttccagtttactgtagtggctttgattcacaccaaattctctgctcatttctgcctgacttttgccaagctgctggcggtaagacaccagtctttgagatatactattgtgctccaacgttataaacattctccaataatttccaatttttactatattgtagaatgtttttcttgtcctcctgtatacccatttgtgaatatttgtcgaattttggcaataaaaatgggaaaaggcaaaacccttttcccaaaaaatatttattttactgcttcttttaactttttaattaattcctgcacttcttccgtactgattccggcaaaacttctcaaagcacgaagtggagaattttccatcatcttaatcatcatctcttgagaaattgcttcgcttgccgcactgccttcttctccaccaccgatgtttgccatcatctggtctactaaatctttcatgacttcttttgctttttcattttccatcaattcagaaatggtcgtgtttgtatgaatttccatcggaatcttcattgtagattcaagttctactgttttggttaatcgaatgtctctggaagaacttccgattaagatttcataagttccgcttcccgcataccagtcatttacttttgtattataccatgcaaaacttcgtttattaagttccattgtcacagtcttttcttcctgtggctgtaattctactttcacaaagtttttcagttcatttaccggacgcatgactgcatttgttttatcagaaacatagagctgtaccacttcttttcctgccatttttccggtattttttacctttacactaacctgaagggtttccgtatctttgattttttcttttgaaagctgtaaatcactgtattcaaatgtggtgtaacttaaaccatatccaaatggatatcgaaccggcatttttttcatatcataatagcggtatccgacaaatacgccttctttatattccactttttgtccatctcctgggaaatttaagtaagatggattgtcttctaaatgatatggaatggtttctgccagttttccggatggattcactttaccaaataagatatctgcttctgctgcgccaactgcctgtccacaaagatacgcttctaagattgcacttacgtcatctgcccacggcatttccaccggtgaaccgttatgcagtacaactacaacacttttctgtacttttaagatttcctgaatcagataattctgacagtctggcattcccatatgttctctgtcatatccttcggattcaaaggcatccggaagtcctgcaaaaataactgcaacatctgcattttttgcagtttccacagcttcttttaacatcgcttcgtcaattttatcttcttttacatcatacccctgtgcataagcaacttccgtatacgcttttaccgcatccagtgcactttctactttaaaagaattaatatgggaacttccgccaccctggaatcttggtttttctgcaaatttaccaataaaagcaatcttctgttcgccggctttaagtggcaggattccgtcatttttaagcagaaccatcgattcttccgcaattttctttgcgatttgatggtccgcttctaaatcaaatctgccttcctgacgattatctgtatatttaaaaataatatttaaaatacgttctactgcggtatcaagcacactttcttctaatgttccatctttgaccgctgatacgatttctgcatcggtatatccaccgcttcctggcatttccaaatccagaccggcttttaatcctttcacacgttcattaactgcaccccagtcagacatgacataaccttcaaatccccactcatctcttaaaatttctgtgagcagtttatgattttcggatgaaaattcgccattaattttattataagagcacatcacggtgtccggtttgccttctttaatcgcagtttcaaatgcccctaaatagatttcacgaaatgtacgctcatcaatttccgaagaacaggacattcttctatattcctgattgtttgctgcgaaatgcttaatcgaagtaccgatgtttttagactgtactcctttgatgtgtgcccctgccatctcggatgcaagatacgggtcttccgagaaatattcaaaatttcttccacacagcggagaacgtttgatattaactgccggacctaaaataacagaaaggttctgtgcctgacactcatcacctaaggtctctcccaatttgtataataagtctcggtcaaatgagcaggctgtcgcacacgcagttggaaagcacactgctttaatactatcatttgctccaaggtggtctgcctcctgatcctgttttcttaacccgtgaggaccgtcacttaccatcacactcgggattccaagacgctctacactctttaaatgccagaaatcttctccggaacacattccggctttttcttctaacgtcatctgttttacaattgctttaatatcacgcttcattaaaaaataattcccctttctacgttggttttctactttaaactttatcacatctgaaccgttctgaatatcaaaatttctattttttttatacaattatcgtatctttatctatccaatatgtatagaaaaagaagtcacggcaattgccatggcttctttttctcttttcgcttttacttattcttccatatttgcgtaagcacgctctctgtctttttctttaaacttatgagcatcctcaagcatcatatcttttactttcatcagacgaatctgggtacttctctcattttcatccaatttcatagtaatatatttaatattattctgtgcttccggaataattacatgttccagagcgtttactctacgacgggtcttttcgatttccgcagccatcagctgacaggatttctccacttcagccaggcgcagcatatccggcaaaatgtctgccagtgattttaccgcaccatccaaatctccggaagtaaatgcaaaaccgtaagaataaatatcatttgcatcagcagttcttgtctgtgactggaataccggaatatcaacgctcattacgtttttctttcccgcttccagataaacttcctgctttggtgccatcagcgcagtatttaaaatctgttctgacattccggcttttgcaatgacaaagttcttatttgcatttgcgattccctcttctacttttaaacgcagagccatgttttcccttgccaggtcaaggaactgacgcatcagttcatcacgtttatcctttaaaagtttgtgtccttttacggcagtgactaattttttcttctgcttgttcagctccattctggttggatttatctgggtagatgccaaatccaatcacctctttcaacatttgccgtaatattcgtccagatacttgtcatcgatacgtttcagttcacttctaggcagtaaggaaagcaatttccatccgatacgaagagtttcttcgatatcacggttcgcattatatccctgtgaaacatattcctgttcaaatgcatctgcaaattttgcataaattaagtcgatatctgaaagtgctgcttcaccaagaatagtcatcagctctttcgcatctttaccacgcgcataagctgcaaataactggttcattgtatttgcatggtctgcacgggttttaccttcaccaatacctttatctttcagacgagacagagatggtaatacatcgattggcggtgttacaccttttctgtaaagttcacggcttaagataatctgaccttctgtgatgtatccggtaaggtcagggattggatgagttttgtcatcttcaggcatggtcagaatcggaatcatagtaatagaaccattacttcctctcttacgtcctgctctttcatacattgttgcaaggtctgtatacatgtaacccggataaccacgacgtcccggaacttctttacgtgcggcggatacctcacgaagtgcatcggcgtagtttgtgatatcagtcagaataaccagtacgtgcatatctttttcaaatgcaagatattctgctgcggttaatgccatcttcggtgttgcaatacgctctaccgcagggtcatttgcaaggttgataaacagaacagttctgtcaatcgctcctgtttctttaaagctttcaataaagaagttagattcctcgaatgtgatacccattgcagcaaatacaacggcaaagttttcacctgttccacgaacttttgcctgtcttgctatctgtgctgccagctgtgcatgcggcagaccggatgctgagaagattggaagtttctgtccacgaaccagtgtgttcagtccgtcaattgcggatacacctgtctgaataaactcttccggatacattctggctgccggattcattggcagaccattgatatctcttctctcttccgggagaatttccggaccatcatcaatcggacgtcccagaccgtcaaagacacgaccaagcatatcttctgatacaccaagttccatgcttcgtccaaggaaacgtactttactgttggacaggttgatacctgttgaactttcaaataactgtactaaagcgtccgttccgttaatttccagaactttacaacgtctggtttctccacttgccagctcgatttctcccagctcgtcatagtgtacattttcaacaccacgtactaacatcagaggtccggcaacttcctgtatggttctatactctttcggcattttagaagtccccctttcctaatacattcgcaatttctgatgccagttctttttcaatgcggtcgtattcttcatctaatttatcttctgtcacatatttgaaacgtccgattttttcacgaacttccattttaagcagtccctgaatggaagcacctttttccaacgcttctttggactgttcataaaatgctacaaccagctgcatcagcaaatgctgttttttcagtgagctgtaggtatcaacttcatggaaggagttctgatgtaagaagtcctctcgaatggaacgagccgcttccattttcaaacggtcgcctgcggaaagtgcatccatacctaccatcttaacgatttcttccagttctgcctcatcctgaagcagacccattaatttctgacggttttccatccaatccgatgcaacctgtgtattaaaccaatcttccatattgtcaagatacagagaataactggtcaaccagttgattgccgggaaatgacgtttataagccaatgcggaatccagaccccagaatacttttacaatacgcagggttgcctgagaaaccggctcggaaatatcaccacctggaggagacacggcaccgataacagaaagtgctccttctctcttatcttttccaagagaaattacatgtccggctctttcatagaactgtgccagacgagaaccaagatatgccggataaccttcttcacctggcatttcctccagacgtcctgacatttcacgaagtgcctctgcccaacgtgaggtggagtctgccatcagcgctacggaataccccatatcacggaaatattctgcaattgtaataccggtataaatagaagcttctcgggctgcaaccggcatatcggaagtatttgcaatcagaacggttctttccatcagagactgacctgttttcggatccttcagttccggaaactcgtttaatacgtctgtcatctcatttccacgttctccacatccgatgtaaacaacgatatctgcatcggcccattttgcaagctgatgctggattacggtttttccactaccgaatggtccaggaaccgcggcaacaccaccttttgcaattgggaagaaagtatcaacaactcgctgtcctgttacaagcggcatttccggaggaagttttttcagatatggacgtccacgacgaaccggccatttctgcatcattgtaagttcttcttctccgttttcggtttcgattacagcaaccacttcttctactgtaaattcaccggctttaattttttttactttacctttgattccgtaaggaaccatgattttatgatttactacaattgtttcctgaacagtaccgagaatatctccggcttctacttcatcacctgcttttacaactggttcaaagttccatttgatatctcttttcagagaaggaacttcaacacctctttttaagttagttccggaaactttcatgatatcatcaagtggacgctggattccatcataaatactggtaatcaaaccaggtccaagttctacggaaagaggtgcatctgtagattctaccggttctccaggtccgaggcctgatgtctcctcgtaaacctgaacactggcttcatcaccatgcatctcgatgatctcaccaatcagacgctggttacttacacgaaccacgtcgtacatatttgcatcgcgcattccctctgcaataaccagcggtcctgcaacttttttaatcgtacctttgctcatgggaacgaatcacctgctttctaaaatattcgtatcgtgactttaattaatcatcacgtttcacttccaaaaaggatatccgagccaacagcctgctctacggatttcttcacgccttccacaccatcgcctgtattaccggaaactcccggaatacggataacagcagggaaaagctgctcctgaaatttttcgattattttttcacactctgcagccatcgcttctgtaatataaataattccatattcatttgctgcaagtgtctctaatttttcttcggcctcttttcgggatgttaccggaaacgtgtcaagacccagcgccgcaaagccaaaaatgctgtcataatcacctactaccgcaatcttatacatacatttcccttaccctttcccgaatagaatcatccgacagtccgctgcgcttaccggacacaatgattcgtaccgtttttatttcattttcccttgccagcacataagctaccaaaggacctaccgaaaacgactgatatttctgaggttgcatggtctgcatcattcggttgtcacaccaacgttcaaatgcggaagctgattctgcaatcgctcttccaccttctgcatactctgtctgggaaagatactctacaattgcatccattccactgactgctgcttttgcaagctgggttacacttaatgattcacattccgccatcgcacgcttcataaattccatagattttgcggttttctgtgcacgcacggcaatcttaatatcggcaatggcaactgtcgattcagcatactctttaataatgctgtcctttgcctcttttcctgcctgatagacagcttcgagctgtgccttgtctatgatgatatcacaaagctgcccgtctctggtatgaagcagtgcctcataagcttcttttgccgcttccgacattatctttggaagtctggaaaaatctttgcttcttacaatctcaagcatctcatccggactgatggaagtatcttcataataaatatttaaatgctttccactttcagatgtacacgcatctttaattgcagcttttaaattgtgaaacagattcggataagacaatacatcaaatactgacatatccacccctaaatcacggattgtctcccagattttttcctgctccctgcttaatatcgcctctgcattttccggtgtatcggcatctccccagcctttttcctgaagcaactgcaggcactgcacatctgtctggcatgccatcagctgttcaatcaccgctgaatttaataaagatgtctctaacgcacggattcgcgcaaccgcataagtgtattttgtatcaatcaaaacaagttcctcctttttgcggttatcgcttatgaaaataataatacatgaactttatcggaaagttcacctttcttggaatcgaacattgccttaaaggtacagttttcttcgattcctccatataaaagaacaaaaccgccgcggatattatcatttccctcttttaacagagtcagttttccgccttttttggctgcaatgtccataatttcgctttcaaaattttccggcattctctttaaatcattggaagagaagcagatgcttccctcctgtggcagaacgaattttttcagcattttgcggataaattcaaaataagatttatcatctaacaccaacagtgcttcataaacgtcatcgagaatctttgcaatcacttcctgttttgcctgaagaattgcttttcttttctgcaggtcacgggaagatgctgctctttcttttaccgcttcgagttccgcctctgattttttggagatacgcccacattctgcctcagcattttcttttgctgtctgcattactttttctgcatcctgcttcgcttcatccaaaattttctttgcacttagctctgcttcgttcagaatctggcttttcattttttctaatccagtcatccctgcgctctcctttgctctttttctttcctgtttctatttttcgccctataagttctgtaaaattagaaggacaggtttgttactgaaagaatagaaatcagaagagcaaggattgcataagtttcaaccattgcagggaaaagcattgctttaccaaactgttccggtttctttgctacaataccgattgctgctgctgaagtcattccctgatatttaccggaaatcagacctacaataccaatcggaaggcatgctgcaagtactaaaagaccctgctgaggtgttaaatctaacattccgccacctaataaaccgattttagaaagtgtaataaatccaactaacagaccataaataccctgtgtacccggaagaagctgcataatcagaactttcgcaaatttgcttgggtcttctgatacaactcctgaagctgcctgtcctgcaatacctacaccgattgctgaacctgcacctgctaaaaatactgctactgctgcaccaagtaatgcataaacaattcctaactgactcataaataagtttcctccttaacatccacgtatttcgtagttaatttaaatgggttaaatggctttccgccaccctcgtaaaattttccgaagaattctacaaactgcaaacggtttgtatgcacataagcacctaacaggttaattgccagatttaatgtgtgaccaatgataaatacaacaataaatccgattgcaccaagaattccatctcctaacatacttcccatctggtttacaaccgatgcgataactcctgtcgcaagaccaagagctaacagacgggaataagaaagtacatcacttaaccatcctgttacgttataaatatcataagctccaagtgccagacgaagtgcaacatttttatttgcacgtccagacatcagaagcagaccgactgcacctgcgattgccattactttacctgtcacagaaactgccggtgggaatgttcctgccggaatctgtgagatagaagcaaagattgaacttggaagcagcattaaaatcaaaccgattaagaacacataccagataataacatcacagaagaaatccatatattgtttttcttttgctaacatatatcctttaattccaagtcccataaacaggtgaatcacaccaaacagcatggagtacattaaaaggcgcatcggatcgttaagaggaacaaaccatactgccttaatcaatcccgttgacggcacatctacgtggaagaatgttcttgcaaccacgtcaatggcatcaccaaagtatccgccaaacaggacaccccatactaaagtggaaagtccacaatacataaacattttcaatgacttatacattccacgctccatgcgcgggaattttttgattgcgatgaaacaggccaggaaaataaccagaccataagccgcatcggaaagcatcagaccgaagaagaacacatagaaaaatgacataataaatgtcgggtctacttctccttttttcgggagaccataagattccagaacaccttctacggattcagaaaatccattgttggaaagcacaacaggtgcttcttcctcttctttgatttcttcaatttcgacaactaaatcatagttctcttccatcgctttttttactgcgtttgctgcttttttcggtacatatccgctgattaaaaatgtcttttcagactgcggaattgtgcctaatacttcatatttctgtgctcttgtacggaaataatcggaaatcacacgcaactgtgcacgcttatctgcacattctttgatatgattctgacaaacttcaatctgtttttccaaaagtccaatttcagcagtcagattttcctgctctacttttggaatttcatcacacagctgagacggtcttgcaaatccaccctgtctcaatgcgttttcaaccagttctgcttgctctctcagacaaagtactactacataagtactgtctctgtctgaggaaagaatcgtaacatctacaccttcgacatccggtgcatgttctgctgtcagtgtataaatttcttccagcgtcataacacttgaaaaacttccaatcagagcttttacgctgccggtaccttcaaaattcatcggtacatccagactaagccatggacttaaggcttctatctgattttctgttttctgaatatttgcacgacattctgcaatttctttctgccagccaaccaaatcagataccacatccatgatgtcttctttttttgaaatactctctgcgtatttttctttttcaattagtgccttgccctcaagactggacaaaaaggaagttttttccggtgcatattcctgaagaatctcaagtgcctggtctgcagatgacgctttcttttcaaagagaattcttgttccctgcgtatcctgcttctcaaaaccactttcgtcctcaagcacctgactgacttccattactcccatggactgcagtctctcaaggatagatttccggtcctttttcagtgcgcagatactaactcgctgcatctgcaatactgccatgttcgcatccctccttttttgttttgttaaactttaagcggatattttttatttctaccgcttcttccggtgcattttgcactcagattaattcggaaataatcaaatcaaccgcttcattcttgcggcctattgccgcagctttcatgctttcaatttctttctccgtctgttttaaagcttcgtctgtgcgttgcttttcggagttctctgcagattcacgcaatttttccgccttctgctgtgcttcagaaaccatgtccgcatacagttttttggaagcttcctctgcttcctgggatatttttaagctctgacgtttggcttcctgcaccatttcatctgcttttttctctgcatccctgatttctttgattgttccttctatcacagtatcaccaccttcacatattttaaatattactatgctttatgcattttgtcaatattttaacgtacaaatacacattttacatcattattttagaataagcacaacacgcaagaaaattcacgtcatactacccacctatttctgtatttttttgtatattttgccaatttccattcaaaaaatgaaggtgtttcttcttattataaatgtagtactttagcacaaaaaaatcgccctgtatttattcaaaaatacaaggcgatttttttactctatttttttatctttacatttcgattgtaaagcggacattcgcaatccgcttcgctacttgctcataaacgcagtcgctttgcgatctgtcagtgggagctttcaactctcactgacagaagcatccccctcacccgccgcttagtgctctgcgcacttgaagcaggggaatgcttatctgcgttcaatttttaatcatacaaataattagcataccgctcatcggaaatattttctgaatcaatccattccattccaggattaatactttcatcattttccattccaagcgctgctcttgctgctgctacaacagttgcatagcccattccataagcattttgtaccagcactccgacttcttttccagacttaatggcatctttttgtttctttcccgcatcgattccgacaactgccacttcttttccggatgcagagattgcatccagcacatcccctgacacattttcattggtacagaaatagccttttacatccgggaacaattttaacacactttctgccatctcgctgacagaagtttcttcattttgatgggaaatatttacaatctcgatatccggatatttttctgcaattgcttcagtaaagccctgctctctttcctgacagttctgagcactttccacatgcgtcatcacagctattttcccacttccgccgattgtatctgcaagctttacagcagcttgtactcctgcctgatagttatccacaacgcaggttgcattgacatttccggttttcactccagaatctaatacaatcaccggaattccattttcttctgctgcttcaagctgagcctgacaggaatccatgtcaattgcagaaaggcataatacatccggattttcaccaagcacagcatcaataatgttaatctgatcctctacatctgtttcatctgacggaccttcaaaggtcagctttattttgtcatcacctttataacccagtttttcatttaaatcagccactgctgcgtccataccgcgcttaaccgaagtccagaaaccgctctttgtgctctttactaccactgcaatatgacttccggcctctaaattaatttcttctaaagaagtataatcaatcgagcttccattttcacgaagcttttgcatggtcaaatcatccttcatatcatcgttctcggcatctgtattttctgactcgtcaccttctgattttgtatctgttttgatgtcggttgatacattctcttgattttccgtattctctgcaccttttgagtcattttttgatgtatcgtctttttcgttctcgttatccttgtctgtctttgtctctttttcttctttcacactagaacttgccgctgtttcactcttcttgctctggcaggaagttatacttcctgttgcaagcactgcacataataaaactgcaactgctcttttcatacactttttcctccgcttttttctccaggtgtttctattcttctcactacactattttctcagccgataactcctgtttatatgagtgagttatcaaccagtttgtatcccaaccacgttttcattatacacgaaacagtttttgtgtctataggtattttgtgataaatttgtgaagaaatgcactaaagcagccaggttcaacgtgtaattaagcaaaatcgcgtatttttatttatttcatgctgtcaagctaccggaaaatgctccggcgtcggaagttcaaacttcatctgttttttcgtaatcggatgcgcaaaatttaacttatacgcacagagtgcaatctgcacccattcctttgttccgacaaattccggattgtacttggtatctccataaagtggaaatcctgcattagcagtctgaacacgaatttgatgatgccgtccggtaaacagatggatctccaccaatgccatttcatctttttcttttaacacctgatactccagtactaccttcttctttcctgcctcagattcttttgcaattctcgacgtattcttttttgcatcttttatcatccagtcttctaatctgccactctttttttccggtatcttagatgtcacagccagataatacttatccatctttccgtcctgcatttgtttattcaatcccgccgctgattttttattctttgcaaaaacaaggattccctcaaccggctgatccaaccgatgaatcaccgcaagatacagcggctctttttttctcgccagatatccgagcagggcatgctccatatcctgacttccaacctgtctgctctgcaccggcatgcccgctggtttatgacaaaccagtaaatccttgtcttcataaagaattgtgtcctcaattactgtatatcccattttatttttcctcgtctttccgtctccttaatgtattctgaaaattttattcttctgcgcacacaaggacaaccgccataccttcaacttttttcagatacaacggttgccctaatgatgttctgcgttattcaattttaataattcctctcttttttattatttgtattgttattttttatttaacactaatacctgttcttataaaaaatttggaatgataattggttatttagttcctcttaattttattttactatattcaattatcaaatgaaatatcttttccggtttctctctttattccccattttacaacttttattttcttttcttagaatatagattggatttctttacatccttactttttattcttagaaagttaaaataatattgctgaaagttcatatcatctatattgataataaaaagcttctttcaaatatcccgagcatttgctttcaaaacatttctttatatattttttcttgatataaagttctcaggaaatcaaaacaaatattttcgattataagtatataaatatctatagataccaactgattaaaaccgactttctattttttactctatctttgtttttcttgatttcatacctttgaaggatatataaatactctgttttttcaaaatatatttctttacatatatcttgaaacctttttatcatcttttgtggtaatgattcaatatgaggacatttttgatattttacctgatttttatttttaaaatcttattttggaatttctgaaaatttcctaatggaaatcaggtctttcttagggaactatgccttaccactctcatactgataatttgttgtctctgttatttccaatggacgttacctccttatcaatatttcacgattccaccttttactttatccttagtacttctctaattatgatttattcctattatatactctccatacacttaaggaaaaatgataactatcgtttgtaccttgtagccaacttcctaaatagatttctcttctcaatatctaggaattggttatgtagtaattggtgttttcttttgatggttatatattaccatgctaaagcatatttgtcaatatattttttataaaaagttttatttttagtaatttattttttatttgatttttattgctgtaaattgtggattattttttaaattatatatacaatttattttatatctaatctttcgagcaattacggcaatagctctataattacacagtaaagcggacattcgcaatccgcttcgctacttgctcatgaacgcagtcgctttgcgatcaaaaagaggatgccattctcacagcatccccgttttaagtatttatcctctataatagttgattaaacagcctttcaagataatctctctctcatcatctgtcaaatcgcctaattttaatgtaaattcttttaatttatcaccgactacataagccttgatttcgtcccatttttcttctactgcccggcgaatctgcggaacaaagatataatctttattcttaaacggcagttctccgtccgaaatcaagaatggaagcatgccccagttaatcagattggaacggtaacgtttggttgcatactcgtttgcaatatttgcccatcctcctaatactttctgacaggatgccgcctgctctctggcagagccgtcaccaggtttcactgcaaaaatggtacttccgattccggtgttttcactgttcatgtccgggaaagaatccttaatcttatcccataccggttttaattctgcaactgcttctaatgggcagtttccttcttctcttgctttttccgctttctggacttcttttgcaagaggaacataatccgggtcttttcttgataatgcaaattcagccagtttcagtggattagaacggaaagaagaagtttcgccggatggaatcagttcatccgttgttgtaaccgggtcatgaatttcagagactactttcaataccagattatcggtcagtgcacacatttccggccagtctttgatatttggaccaaactgaatttctgtgttcgggtctgctatacccttactgtcaaagactctgttttcataaattgtcttatcaaagaaataacgcggtttcgtatattttacatcaaaatctgctgcggaagtaaggtaccccttatttgctgcagttgctgcaatggaacgtgcatccatcaaagcgacagaagaaatctgaccattttgaatcttagaaccttcacgatttgggaagtttctggtagagtgacgaatactaagcgcattgtttgccggtgtatctccggctccaaagcaaggaccgcaaaacgctgtttttacaactgcacccgtctgcattaaagaagccagcacaccattttttgcaagttccacataaatcggggtacttgccggataaatgcttaaggtaaaggcatccgaaccaatgcttgcaccttttaagatatcagctgcatcacagatattttcaaatccaccacctgcacaacctgcaataattccctgctccacataaagttttccgtcacgaactttatcttttaaagtaaatggaatcttgccgtccagactaatctgggctttcttctcaacatcatctaaaatatcatataagtttgcatttaactcatcaatggtataagtgttgctcgggtggaacggcattgcaatcatcggttttacctgacttaaatccacataaaccatgccgtcatagtaagtcactgcgcccggcgcaagttctttatattcttcacttcttccatgaacctcatagaactctttaatcttatcatccgttacccagatagaagacagacaggttgtctcggttgtcataacgtcaattccgattctgaaatctgcacttaaatttgcaactccaggtccaacaaactccattactttatttttcacataaccatttgcaaatactgctccgataattgcaagtgccacatcctgtggtccaacacccggaatcggttttccggtcagatagacaccgacaacctgcggacgacgaatatcataagttttagaaagtaactgctttaccagctctggtccgccctctcccattgccattgtaccaagcgcaccatagcgtgtgtgactgtcagaaccaagaatcatttttccaccgcctgcaagcatttctcttgcaaactgatgaatgactgcctgatgcggcggtacatacattccaccataacgttttgcgcaggtaagtccaaacatatggtcatcttcattgattgttccaccgaccgcacaaagagaattgtgacagtttgtcagtacataaggaatcgggaatttttccagtcctgaagctctcgccgtctggataattcctacgaaagtaatatcatgagaagtcaatttatcaaatttaatctgtaaatcatccatattgccggatgtattatgtttttcaagaattgaatatgcaattgtctctttggaagcttcttctttggaaacaggtgctttgcctgtcaaatttgcaattactgctgatgcatctttattatcttctacaatttctgtgccgtttaccagccatgcaccgccattatacaacttaaccataaccatactccttcattattattggtgtattttactagtgaactacccatcttctatatgtaatgggcttctaaggagctgacgctcccatttaagaagtctgatatttaagtttccacctaaccaatcaggcactccttattcttacaggcgtgtccacctcgcctctgctgtataggatattcctatccacaacactacttttacgctctaattataaattttattacggtaaaatgcaagcattttatcactttattgtatgaatttaattgtatacatgagtgcacgtattcttttaaagcataaaaaaatacttcccgacttttttaacaggaagtacttttcttattttctatcgtgaattacttggctgcaagcaaccaagcttttcgcttaaatcaggaaactatatcagtcctgattgttcataaaatccatgtaactggaaaccataagcgcaatcttaaaggtcaatgcgtcatcaaatacacggatatcaagtccggtgcttttctggattttttctaaacggtacacaagagtatttctgtgcaggaagagctgtcttgatgtctcggaaatatttaagttattatcaaagaatttattaatggtatttaaagtttcatcatccagagattccggaagctttccaccaaatacttctttcatgaacatttcgcacagaggcattggaagctgataaatcagacgaccgattccaagattattgtaacctacaatatttttttccacatagaaaatctttcctacatcaagtgccatctttgcctctttgtaagagcgggatacatctttaatttcatggatgatatttccataagaaactctcgcttttgccatcgcctcagaattgagcatatctacaatcattcttgcaatcgcttcgatggattcataatcgtcgctctcttccagattacgcacaataataatatttttctcatcaattgccgtaataaaatcattgcttcttgaaataaacatatttttcaggatttcaatcgcatcctgatctttctcgtttcttatttcaaccagaataaccacacgttttgcttctaccggaatgtgcagtttttttgctctgttatagacatccacaagaagaagattgtcaagaatcaaattctgaataaagtttgatttatcaaaacgctctttataagccacaatcagattctgaatctccgcaactgcaacacgcccaatcatgtatgtgtcttcgtttccaccttttgcaatcaatataaattcgacagtctgaccatcataaattttgaagaaatgatacccccttatgacctggctatctgccatagattccacaaaactggatatatccccaaaatcctcatcttctatcggaaaagtagttgaatttactttgccgtctacgtccatcacacataaatcaattcttgttatgcttctcaattcatccagtgtcttttgtatcacctgacttgatatcatattgtatcctcttttctctgtatttttataagtttctgtcgccgtaaaaccacatgcctttcggcgtgtggtagttcacatcaaaatgcatattatcacaaaaaaacttttcgttattttttatataatatcttattttactaaaatttgcaagaaatccaacagttttttgaactgccccaaccgactaatgcggatggggttttctgctctatagtagataaaaaaactgctgcggaatttccgcagcagcttgaattatcgtgaataacgaacaattagttagcgataaccagttctgtttctttatcaaatacatgaattttttccatatccagagcgaatttaactttatcacctgttctggcagttgtacgaggatttactcttgctgtcagatggaatccttcgatatcgaagtataagtaaacttcagcaccaagtaattcataaacagtgatgtcaccttcgattacgctttctggatgagcagcgatagccatctgttcgtcagatacatgttccggacgaataccaagaacaacagtttttccatcatatccgccgtcgattaatgcttttttcttagaagccggaacagacagagtagttttaccaatctgaagtgtaacatcttcaccttttacatggcaaacagcatctaagaagttcatctgaggagaaccaatgaatccggcaacgaacaggttgcatgggttatcatacagattcttaggtgtatcaacctgctgtacaacaccatctttcataactacgattcttgtacccagtgtcatagcttctgtctggtcatgtgttacgtagataattgttgctcctaatctttcatgaagtttggaaatctcagtacgcatctgaacacgaagtttagcatccaggtttgacagaggttcgtccataaggaatactttaggttcacgcacgatagcacgtcccatagcaacacgctgtctctgaccaccggaaagagctttcggtttacgatctaacagtttttccaggtcaaggattttagctgcttctttaaccattttatcaatctgatcttttggtacttttcttaatttcagaccaaatgccatgttatcgtatactgtcatgtgtgggtacagagcgtagttctggaataccattgcgatatctctgtcttttggttctacatcgtttacaactttgtcaccgatttttaatgtaccaccggaaatttcttccagacctgcaatcatacgaagtgttgtagatttaccacaacctgaaggtcctacgaagatgatgaattctttatctgcgatttcaaggttgaaatctttaactgcttcaaaaccatttggatatttttttgtaatatgctgtaatgataaacttgccattgttctcttcctcctaattgttacgttttcacgcttatgtttcgttttccacgcttgttctgctgttttaaacgtttttgtctcgttttcaactgctatcagtataccactgaccacacacatttttccataggtcaattaaacaaatattatcacaagtcttagttagcctctccaacgaaaatttcgccattgtcattctgccgaatttcccttcttcaaaatatgcatattgcacaattttgattggtaagacctgttttaaagcaagtttccgcgtttttttcttgtaaaattccaatttttttcttctttacagaaatctttttctttcttatactgttttaagacaacaatgtaaatctatgttactatgtttcgaaattggcaaaaacagaaagcgcaccaacacttatgcacgaaaggaaaattactatgtttcgattaatgggatgtatctataaagacgcacgtattttaaaaagcacggttatctgtgatgaatcagcttcaagcagaactcataaaattttctccggactcaattttatctgtctggaatttgaccttgaaaaaccaatctggctcgaatccaacatcacagattttcagcgtcattcaaaaacccgctttacgcaggataacttcattgaggaacttgattttgactatctctccattgaagtaattgaagagggctaactcaggataattcattagaagagagataatttattaattaaagtcagaccagttctcttacgaccaaaaacagggacacatcgctttcgatatgcccctgcccttttctcctaaatgaaatctattctaactcaaaaactctttaatcacatcttttacaatcttctcctcctcttcatctaaaagatgccgatagcgttcatccgtaagcgcagcttcccgaatcctcgcttccacctgttccattttctgctgctgactccgtaccgcagacggactctccctgcctccgtttcttgcccgctctttctgcgctcgtaaaagttcttccctgagcttctgctcctgctgtctcgccttactgcgcgccttcctgctcattttttttgcagcagcctttttcgcctcatttgcaatgggcggttctatcttcacaattcttcctgccgaatccttttcattttccatataatccagcagattcgtctctatcatctcctcctgataggcaatagaaaaaatcaggcgcagcattccatttactgcaccaagcaccacagttgttccaatcagcccctccatagccggcatgaaacttttcacaaacggaaacgaaagtgtcataatgcctgtccctctcacctgccatacgccaactgcagatacaaaaaaagagagaacaaaagctgtccaggaaaatccctttagcattcttacggaaatcttcccaatctttcgttctctcagccgtcttgccatataaaccgacggattgtgtatcgttatgtgattctgcgtatccctctgaaattcctgcagatacgcctgcagccatctgttcttgacctttggaatctgctgtaaatcctttaagactccacggttgcttttgtaaaccaccagcatggtgatgatacttaccagctcaaaaagccagattccgtaataaaacaattccacagacaaccctcctagtccgatgcacctcttctgcatctttatgagaccattatatagcagagctgtctgtttgaaaacaaaaatcgtacgacaaattcagtcatccatgcctcgaattttgtcacacccaccaggcaaagcggacattcgcaatccgcttatctgcgttcaaatttccgttttacagcatgagaagcagttcctctaccagtttgacagaatgtaaaattgcctgtctttcaaaagtcggataatccacctgtgcgctgtcatctgctttgtcagaaatcgcccggataatcaggtatggtattttatttaaatgcgctgcctgtccgactgctgttccttccatctctgtacaccagccattggttctctcaataatctgatttttcagagccttatctgccacaaactggtcaccacttacgactcttccctcaaatacactgatttccggatttactttctcgcaggctgtctttgccagttttcgtaaagtttcatctgccgggaaagcatgaacatccatacgcggaacttgtccaatcggatacccaaattctgttgcatccatgtcatgatacatcgtgtctgtggaaagtacaatatctccaatgttgatttctgcttttaaagaacctgcgattccggtattaataactgcatccacctgataatcatctgctaaaatctgtacacagattccggcatttacttttccgattccggaacgaaccacaacaacttcttttttatttaatgttccatggaaaaattccattgcagctttttcctttaccgttacatccttcatctgctcttttaacattgctacttcttcttccatagcaccgataattccaatacgattcattttaactttatctcctttatttcctttatcttagcctttttgctattttcatcataacacacttgcaaataaggtacaattcttaatccttaacttaataaagggtgcagactttttcgctctgcatcctttttcctgattttcatccttaccttttctattctttcttttcagataagtgttctgcctcatcctcatctttttcccgcttcgagtttatcacagaggcaattccatgcagaatcactgctcctaaaattgctcctcctgccagaattttcccataaactccagtcagcacaagtgcaatccctccgacttttggaatcgaataagcaacctttccaataaaattatcatacggcgccgggttcatatcttttgttgcattagcatcaccttttgtgataaattcacccatcagtacacgattttccacaacgcggtgcgtaataatagaagccgcatcctttgttccataaaatgcaatcacatcatctacctgaacatcctttggctccatctctttaatataaaccagacttcctgttggaatcgccggctccatacttccactgattactgtataaacatgataatgaaatgcttttggtacggtaagcggaaggcagattacaattaatagaattaataaagcagtgcccagtgcactgcacacagcagccactgggcttttttttgttttttttgtattcaagaccaataagtcctttcgtcatgttgtatgcttatttctttttagccatgtatttctttaataatacacccattccggcaagtactgcaaccccacagatgccaatcgcaacacctgctgcaacaggaaagccttttttcactttcccctgatttatatctgcgtctctggaaagaggagtctcatcttcgtctaaatcctgaatctcctgtgttccctgtggagtctggtcttcttcaattgtctgggtatcctgagtactatctgttcctgcgtctgtatcagtcgttgtatcggtctctgttgttcctgccgttccggcgtccgtatcagtcgttgtaccggcatctgtgcctgttccggtttctgtcgttgtaccagctcctgtaccggttgtgcccgtaccggttgttcctgtaccggttgttcctgtaccggttgtgcccgttcctgttgttgttcctgcggatgtcgtagccggtactgtaattgtttccacatttgttgttcccggaacaactgttgttacagttgttgtctctcccggaatcgttacaaccgttataccgattggcgtataacggaaggtaaatacattttctgcggaattttctgataacgtctttgtaagcgctaatgcctgaggagtatatccttccacatactgataagcaactaccggtttgtcacccacatttccataataggtattgcttgcaagcagttcctttccatttgcatcctgataattgactgtataagcaacctgatttcctttgattccataagcaactacataatcggcatcgccttttaccgtaacactgtatctcgaagcttctaattcatcggtttcactgttatcacgtccactcttacgaagcccttttacataatatttatcgctgttatttaacgttaccacaccatctttctgtacatcgaaagatacgaaagctccgtattttagattgctcatcacaatcttacctgctccgtctgcaaatgtaccttgatttccggcatagaatgtaacggtataagtatattcgtcatctgcgaaaacagaaagcagagaacactgaaacatcatgcagaaagccactacaaaagttaaaatctgtcttaacttcttcactgtcctcactcccctttctcatcctcgcgacgtctctttactgccaaaaccgcgataatcaataccacaattccactcaccagtgcaatcgcactaaacaataatgcatgcatggtatcaccggtctttggacttgtcaccgctgtttttcggattgtcgaagattttccggtcattgtctttttgactactttatttttacccttttccacttttgtctttttggaaactttttcaactgcaaaatttaactgtaattttgcaagtgtattctgatatgcatttccctgagtttcaccctcaagtccgacttctaattcaactgttcctgtttcattcttatccagacgatccagatagaaataatcttccatggaatttgttgcctgatgaagaccttcttctccgcttttcttatcctctccacctaccgtatcactgtcataaagtacggtttcttcaccggaaacatctttataagaaagtttgtaagtataagcgccattctccgcctgactctcatcttccagactcttcaggatttcattggacatataccagtctgtctgaatgctctctgagtttttaattttcacaccaattttcatggtatcaccaggaagcattccataaacttcttctgcgatctcttttgagctaaagttactgtttagcttatcattcttaaaatctaccgtccagtctttactacttgtaatctcttctgctttcgcagttgttaccgtgccaaatgtcataacagccgccatgaccaggcacaaaatattcttttttaacatatcgtgcacctcctgtggctactgtaagctgatactgtttccgtcttctgagactgtcacatcaatcccccatgcactcttgattgcatcctgtgcattgtgggtctgtacggcatcggcttctgcatcaatcgtaaaatgatatccatcgtattcataaatggttttgatggtcttcttgccctcttcttcggaaaccacctgttcctttacctttgttccgatagaagggtcaactgttaatgtatcactaattgccggagcgctttctcctgccggcaaaagcctggtataataaagtacggtacgctctcttgttgttgcactctcatcaatcacccagccattgtctgtgagcagatttaaatcaatcaaatccggagaaagtctggtatttttatttccgtctgcgtcagtccagctctttgtaagaatgacccttacaaatgtatcaatcgagccgctgttttgtacggttaaggcttcatcgtaagcttttccaagcgcaaatttctcatcttttccaaccagatttttaagaagttctccatgttcttcaacccactgattatccttgttgtaatctctcttactgattgtttcaccattttctaaaaggctgataccaatctttgaaacctctgcctgcactgcataattctcactgtaataagtcagtgccgctcttgtacttcccacggtactgccaagaattaaaagtccggccaccgcaaacaggaaaacgggctttacagaaaaggattttttcttctttttcattactcacccacctcctcagtctgcgcaacatctgctttctttgtccagtctgcacttggatttccctctacatctaagataacaggtgtacattctgaaacaacaattacattaaaatcttttggaaggttcatgttactgatttttaccaataattcttcgctctttgccccaggtgctataacatcagaatagtaataatatccgtcatcccccggcgtccattttccactctcatcggagtagaccagtccttcctgatactggcttccggcaaatacttttactcttacataacattcgtaatcaccggtattttcaattttgatatgcttcgtccaatcactgacctcttcatccggaataacctcggtaaatccaagacttaattcctgtccaccctgtgctgtcacataagtggtaaagtaagccatggcacttcctacagaaagccctgcggtaagtgtaagagctgcagcagtcagacaaagcgttttcttattcaactttttcttcattgcttaacccctccccttattcctgtgcctgtgtactgtccgtttgctgttcccagtcccagacaccatcttcggctgactgtttctggtcatctgcggtttcctcatttggagtaaattcaaaatgattgacaacacttgaacctccatttaatttaccatcatactgattttcaaatgctgtggaaaccatttcatccgctacgatttgagtggtctgctctgcctctcctgttgcctcataacttgaaccactgtaaacttcggttaccgttatatttgcgcccgccggaagttcctttatcacaacactctttgtgcctgttccatcaaataccatggaaactacatcactgtaaacgatttctccatttacttctgcttcaatatcaaatacaaacgaagcacctttcattgtctcattataagaagttaaagttttatcgatttcaaggtcaccatatcgttcctgttggtctggttttaatcctgttgatgtatcataaagccactcgtcgcttccggttacataatactgattattcggcagggaaatcagatacggtgtaaaactgtaagtataatatggagactgcacttcttctgcctctaccagatacattccgactgaaagcccatccacactgcccttgcctccaatcagattatcaaaagctgttgcctctgtctggttctcttctactgccttcactgcactcttggctttctcttcccattcttgtgctgttgtcttgctgctgatggaatccagtttcaattcctcaaatccggctaaggcctgatactctccatattgattcacatctgctaccttatacatgcgaaccggaattgtcatattctcccctgaaagttccggataaaccgcatccagctcaaatttcacagaacactgccggtcagtttcaatactgatagcagcctgaactttggacattactacggtggaaagtgtcaacaccagagccagagccaatgcgcttcctttttttagttttttcttcatcttcacatttcctcccctctgataacagataagtaactatcctgtactgaaaagtctttcttgttctttcttattcttttttattcttttttgtgtttcttctttccaggtttaatcaggaacttcatcaaaagtattacaagtaaagttaccgataatccaagtatcagataaatcatgtagtaattctgaattgatttcaacatggattctgcggctgtagattctatctcttcctctccgttatacggtactcttgtgccacgaactaaaagtctgtgagagtttacaccgtacggcgtacaggtaaatagcgttacatgatcctgaccctcttcaatctggagagccttttgaagcgtctcattgtcatccttatccaccatatctaaaatctggtcaacctgataagcaagcgtttcatccaaaacgtgaatgtaaaacatgtctccacgttctaactggtcaatatccgtaaacaatctggcactcggcagacccctgtgtgctgccagtacgctgtgtgtgctctccccaccgattggaagcttggttccatttaagtgaccgattcctgtctgaagcacatcatccgctgttccatgataaatggacagctttacattaatctttggaatggatacatatcccatgacaccatcatttcccacatttaaaatctgccagtattcggtatttttaatatcgtctccattttctccaaaaacatcaccaaatatattgttatggataatcgtatcattaaaagcattcgctttttcccattcctttgtaaaatcctcttctgccatctttccgattaactcttcataagatgaaatcaattgattctgccggtatgtattccactggttagaaactgtcggataaatcaagattgcaaatcccagcaggaacattaagccaaacaaaatacctgaaatttttctcttcataatacatccctactgttcctttgattttctcttcttatcataacaataaagtataaggataaagcctcctgttactgccagtccgataactacccacaacccataattggtatggagactgactcctccaagtggtgtggatgcctcttctatatcggctgtcttgtaatctactctgtgtcctcgaaccagaagtctgtggctgttaactccataaggagtacaggtaagaagtgttaccaaatctttctcttcctctactgctaaatcatccgtttcttttggttcaacgactgaaattttatctacttcatagcaaagcacgtcatctaatatatagagaagaaaatggtctccctcttcgagtttatcaagatctgtaaaaagtgtagcactcggaagtcctctgtgtgcagaaattactgcatgtgttcctttgcctccaaccggaagtgaacttccttcaagatgaccggctgctttctgaagcacctcgtcttctgttgtatgatagatgggaattttaatattaatcttaggcacttctatatatcccatcataccatcaccaccaaggttcaaacaagaaaaataattagaattttctccatcggaagcctctgcgactgcaaaagaatccggaagaacggatggctgaagagaatcattatatgcatcggcattttcccattcctgctcataattaatttctccatctttttctttctgcgcaacaacttcttcataaccggatatcagctgcttctgcctgtgattgttccactgatttgcaaccaagggatacaacagcaaggacaaaccggctaaaaatataattataatcaatatcgtagtaacttttttcttcatccgggctctccttattgttgtattttttgtcaggtttcaattttctgtgaaatgaaaaaccaaggcgggcgagccgccctggttttttcacaaaataggcatttcaattgttacttattctatttcttctatttcattatttagcagattttttgcgagttgcgaagaataaacctgctgctgcaatcataactacacaaccaccgattgtgaagattgtagtaccgataccacctgtggatggtaagttggaaatcttggtgttgacgatttcaattttttcaactgttccgattgccggtgtatcatcagttactgtgaaagtagatcttacagtatggtcgtcgccggaaatagtagcaccatttacagaaatagaccaagctgttaatttacctgttgtttcgtcgattgtagcatcgattacgattgtgtatacggtatcatttaatgtgtatccgttaggagcttttgtttcttttaagtaataagtaccggctttaagacctgtcatggtcatctggccatttgcatctgttactacaacaccattaaactgtttgttttccggatatgctgttccatatacagtttcaagatcggcatctgtgtataaagtaaattctgcgccggcaagttttactttctgttcgctggaagttgttccaacttttgtgatgagttcatttgttaaagaaccatctgctgttccgtcaatatcaaatgtgtaagtataagttttgtcgttagaagaaccatctttgccatctactttagagtcttttgtgaagtttaaagtagcgtcgttgacatttgctacaccatttaatgctgcatcctgatttactgttgccgcataagttacaactaatgctttgctctgatactgattcagtgtatatgcattatttacaacaaaatcaactgtaatttcattctttgcttcatttactgttaatgtgtaatctgttcctgctgttaattctttaccgtctgctgtaactttcaggctgttttctttataagttaagccgtttaatttatccacgatgttgaacttcggataatttccaccgtagtaaggaattgttgttgaaagttcataatttactgtatcaccaatgtttactgtgttacccttaactttgttttcgccttcaacgatttttttgtctaaatcaggagtatcacttactttagcccatgcattttctgtatctgtaacatctacttcgttgaaatccattgctgtttttccatctttgtttttgtatactacagaaactaccaatggattataaattttattttcagcacctgagataacaactaaataagaacctacaggaacttctgctgtataagtggttccatctgtagaagtcatagcatattctgtacctgcaacttttgttgcatcaataatgtcagcgagctgagctgagtctacagtaatatcatcagcagttacatctgtaataatagttggatataaagattcatatcctgagaactttccgccattctcatattttgctttgataatctggtaagcttttactgtaacgccagtttcttctacgccacttactgtaattgttcctttgtcggatgctgttcctgttgctgcatttccttcggtttttccattcgctgcaaatgtcggaatactcatagcgagtaccattaccattgccaataccattgataacatttttttaagtttactcatactctctctccttttctttccaggatttcccttacttaattattagtttctcttgttacttggtttcccctttacttttgcgatttggaagtcgctgaaaccataatctcattttgttatttattcagcacctccttggatttgtttttatataatattagtgccgcagccatcataagcaatgcgcctccaatcgtatatcgatagataccagaaccgccggtacttggaagttcgtataccacctgattcttgattgttaatacgttcttctcatctgtggttaaaaaccacatattcggtttctgagtaagtggattacctgccatatcggttaaaataacctcacccttttcctgcttgaagtaaatcttattgcctaaaggcaagtaacctgttggagcttttgtttcttcaagataatattctcccggttctaaccctttgagttctatctcatttgctccatttttaacggttaaaacatctcccaatttttgataagcgttaccagctttcttatacagctggaattctgctccatctaattttaagtctgtattattttctgagactttcatcaaatcaaggtctgctgtttcttcctgataggtattcgtaagttctacttctgcatcctgaccatctgtcactgtataattacctgttgcaaacattgcccattgttttgatttatcaaagtgcataatgttttcaccgtcgtaagtaacctctccgtctcggaatgtcaacgtggaactaattttatccactccactaaagaaataacatttctctaaaactgcttttggtgaaaaattcattccatcttttctggaaatcaaatcaacaattgccattcttgctttgatacttgccggctgtctggtccaaacaaaatatccttcatttgaggttaattttgcaacgattaaatttacttctccaactggataatcccgtgcggaacatgttgttgtttttattgttgaagtatattcaattgtcgcctgcttaactgtcacatctgcactgtctccatttgaaccattaattgatggcgttacctgatatccatcttttttataattagactcgacaactctgtaagttcctgttgaacaattttccaatttccaggtgtaaacccaggttgtatctttccctgtcagattctcgtccagcttatctgcatccattgtaagcgttcttgtatcacttccatttgttacggttatctgatacgcaggatttgcttttgccagttctctgatctgcgcttttgttaaaccattaaatctcttagtcacttcaataaatggagcatccggctcatccagttcttttattttgtttgcaattgttacttgagcatcttttttcaattctatttttccatctgcaactctttgctcttctactttttcgtctgctgttttaatgtccgacttttcacaattgctgacagatttttcaggctctaaatatcttgttttatccagattcacttcttctaccagaaaacttgtttcagaaagaatctgtgtaacaatcactgtataacctgccggtattccagtaacaactccatctgcatctgttttgccacaaacaacactcttactgccatttgattccaattctccatctttgtagtaataataatttccttccccatctttaagatagtaatcaccctttgtataaggcactaacgtttgattagcctcattattagatagttgaatcttaaatgaaaaggtatcgtttgttacctgtccatctctcatctgctttgtaatccgaagttcacggctgttatatgcagaacaattatttacacaaactactgtcggtctttcttctactgtctttttatctgttttaacatccgaaatcgttccactaagctgtgcattttcatcaaatgctttatactcaacgccattaataataaccttatcatattgctgggcattcactccaacctctattacataatactttcggttagctttcagtccgctaaatattgctgactcatatggttttagataaaatacctttttatatgtcgtatcattaaatgttacatcctggaacttaactttttctgttgaatctttatacgttgcactatctaataattcatactcgtcatcgtaatacgtttcatttccttttggatctgttgatttaattttctgtgcatagacctggaaagcaaattttacattgctgtatttttctttatctgtgttttccagttcttttctaacttccacctgaccttccggaataacctgaagattaaatttcatgtgaagattagatgcacctgcaccacgttccatgtagaacattttaaaggaatggagagtataatctttcaatgtgtcgtcatcaaaacatgcttctatttctttatcactggttttactcgtccacttatttccattcggaagctttttagcatcttggaaaagttttttaatcgttgtcttatatttttttggtgtacctcctttaatacaatcataccagcttacctctcctgtattaaaattaatactgccggagtgagcatcatgaacaccaccaatatcaagcaccaagacgtcgtcgatataaatccataagtcatcatccccattgaattcatatatcatcgggtctttttgaccactaacctgtttagaagctattttaccatcttttggctgaaaaaaacttgcgcccatatacatcccaaagtaataattatttccatttgttttataaagtgtttttccttttgaactatctgaatctgataaaacactaccattttcatcatattcatttttattagttgatacgttttgactattaattgtgttatacggcataaagtttccacgtttataataatactgattttcattacttggtgtacccagtgcattgtatacggtaaaatttgtattgtttcctaaatatgcataattctgaaaactactgtattcataataacctgtgctgttatagatatcttttcggaataaatgatctacttccgttcctccgctaaaaagactcgccaaactttcattagcagttccgggaattgctgaacccgtagatttctgacctgtaatacaggtattcactcctgttgtaattggatagccatctgtgcctaacacattttttaaaagaccttttttaatacttcctgactgattgttattattctgccagtttccattattccacgttccggcacaatagcctcctcctaaatctatccaggtactactatccaaagcttttatcttatatttgttagaatccttaccttccatatcaatcattcgcattgtaatacccgcttgagcatgactgactgtttcaactttatccaacccggattctttatcggaagcataccaggctagcacataattagaaaaactatctgttataaattctgcctttgtaacttttgtttcacttgttgtctgtatatttgcttctttcttttcatcagccaccatatcgacaacccgttttactgctccattcttatcttcttcaagatgaataactgtaacatcaagatctgatttttctgtatcaacatcttccggtgatactccttttttatacttcatcgtaaccttgacatttccatccggctcaattttatttccatctttatctgtgagtgtaatatcataagccagaaatcctgctatagagtactcttcgtcctctgccttctgatttaatttttcctctacctcagtatattctgtcgtatctttttgaaccgatgttacacttaaggttgttccttctggaattgcaccttctttttcctctgtaatattaattgttacctcttcatcttcgtatgtaagtataggtttggtttcttttatttcagtttcagcttttgctgtctcttctgtttttgtctcttcttttgcctcttcttttacttcctctttaatttcttctttcggctcttcaactatcctttcttctgcctcagccgtttcttttacataacatccataaactccggacttttcagcttttaatagcaccttattaactgcatttttttcctgattcaagctaacatcggaatagatatattcatcaatattatctatactctttccttccgctttcagtgcttcctctaagtctgtttttgatgttatatttaaaatttcatcggattcttttttattttcttcggttgctttgtccagatagaaaacatttatttttttcgtatctgctgtctgaatattggtattgttttcttcaattgtaatggtaaccggtttgtttggattctgattttcaccgtttactttaaaattaatttcatagaactgataatttccaagcttttctgtttccggaagattttttccgattaacgcttttacatgttcctgagtttcggcatccagttcttttacttccatcacaatgtctgaggttaatgcttcaaatgcaccttccggaagatttgcgataacgcttgtaagcacgtttccgttttcatcctgaaattcatgtctgatttcagttgcttcagactgtacaccttctttagaaacagtttcttcagaaacggtctcttctgcaactgcttctgtttcttttttcacttccggtattgtttctttcgatgtacttagctcttcgttaattccttctgcctgcgtctctcccgttgtcgttgtttctgtactttgtgtttcaggttcctgacttgccatggattcagaagaggttccacctatcagaccaccttctgccatagtagacatgctggttgtcagcatcagaaccatgcaaagcacaaacgccagaatttttttacttttctcacttttcatggcttcctccttctactatctcatcctcgtcttcagttactgcaccatctattaacttcaataattctaaggcactgcgaaaatattgttcctgttttgtttctgcccataatacacttccctgccaggttgagttctgacattcattaatctttacgataaatgttttggtctgttttttcttagccacaatatcttcgcctcctttcttttctcaaattaaatcattaaatattctatgttttttactatgcggttattatagcgtattgcccattacaaaaagcattacaccttatttttttattaaatttttccacaaaaaaacattaccatacatctgctggtaatgttttttctttcgtaccttaaaaacttgaagtattgttgataattttaactaaatccagtgcactggaaaactcataactttcttctgattccattaaaacaatttcgccctgccaggttgcattctgtcgatactgaacgcacaccagaaatgttccctttgtgcctttttgttctaatacagttttaggttcaacaactttaggaattgtttctctttgctgtagagctttttctctcaaaaaagacctgctctttgttgatgcttccggaaaatgaagtttatcatacagtttttccatttcatccaaaagctcaacgacatttttaaaattcgtcgcctcttttttataacaatgataaagacgtcctttcatttcttcctgcgcaatttcgtctacacatatatttacaagattaggtgccgcctttattcgtcctatattttgtccgcttctcatattttcatacaccacacctttacctcttaaccttcaaaggtcattctgcccgttgaaggtaatctttgattttttctgttcaacatccacaatagatgatacataatattctaaatactgtgcccatgttttatgctcacggctgaaatattttgtaattctatcataaatctgaggacaattttcctgttttgtccctaccagtaaaatcaaaaactgattcgggctgtatctggtataagagtcgcctttacgcagtgaacatttaattgtatgatccaactcttcagataacacctttaaacgctctttgttttctaatgggcgtccttttccgtctgttaacgttaccaacatcaaataaacagactgaccatttctttcgataatacgggtcaccagacgataggtatcacggaaacttggcagactacagtaatacgcacctttttcttcatatttttcttttaaaccgccacgaatatcctttaatacctgcggtttgtaactgacccgttcgctcatttctttgaactgctccatcattttttcagatggactgatacccaattctgcaaagaaaaattttgccgtatcttcataaagctgaatggcttctttgtatcgattcatagcaaccagcgcttccatcatcacagactgccattcatcaaatggataaatttcagacgctgatttagaaagttccaacacactttggtactctttctgtgcctttttatactcacatacttctttcagtgctttttcataaacttttttatattctacactttcaagcagtgcccagtcctctcccgaaagttccggaagaaattctcctttataaatccggcaggcttttgtcagcagttccatttttgtccggatatcctctgtctcttctgacttttcaatgagcttttttaattctaaggcatccacctcaacttccatcggactgttccacttatagactccctttttaatttgtatgtaatcatactcaggcagtcctgcatctacaagcatttttttcagtctgtgtgaagttacccttaaattgtttgccatatctgccagttcatctctgctataaagataatctagcaaacgagttctttgaattcctgtttcttttgtatacaatagtatctgaaacagctgcaatgctttcgttgacgttgttctcttaaatgcaatgtctttttctccccagctcacagagaaacgtcctaacatcgtcacctttaaaaccggtaattccttactcatccttatacaccccttttcataggatttctccctgtttgtcaaactacagccactccctaatgccgtacttttgcagccatatcttaaatacaaaatatagttactaaactaagcgagtattcgcacttccctttcctgcttacttgctttcgttaatctctttatacttaagatatcctagcttaattctaactttttgccattcttttgtcaacaaaatagattgtcagattctgtcgaaattggaacaaaaaatcttactctgagtttttttcttaattgtaaactataaatgagcaagttcgtgattttgcatttctcatcattttttgaccacaaatttacgacatttacgacaaatctgacaccactttacaataccagacaacaaagacgcaacccacatttctgtgacttacgcctttctctactcatattttcatcatccagacttttcactctgcttctgataatttactgatggcaacagttcttgcagatggcattactttccacagcactccacaatggctttttccacattttctatctgaaatggttttgccagatgtgcggtcatgccggctgcgagacatttttttgcatcttcctcaaatgcatttgcagtcattgcaatgatcggaattgtttttgcatctgccctctccatagcacgaatcgcctttgttgctgcaataccatccataacaggcatcatgacatccatcaatatggcatcaaaggttcccggaggattattttcgaagcactccactgcctgtctgccattttttgcaactgtaaccttcgcaccgtcatctgtcagcagcatttctacgatttctgcattaagatcattatcctcggctaccagcagatgcagtccacaaatatcatatttctctacaatttcctcatcctttttctgtttctctgcaatctcaaagggaatggtaacgacaaacacagatccaacttcctcctgacttgtcacttcaatacttccattcatctgctcaatcaatcccttagtgatcgccatccccagaccggttccctggtaaacactacgggcatctgttttttcctgtgagaatggatcaaaaatgcgactcaggaactctgcactcatccctatacctgtatcagaaatcgtccatctgtatgtacaaatcccatcatgtacatctgccgcctccattacggtagtaatctttcctcccggccggttatacttaatacagtttccatagatattcaaaaaaatctggcgaagatgcagtgagcttccatagacataaggatagggaatatcctccttatttttctcataaatccactgaatattctcatctgctgccttgtgagtgataacgctctcaatctcatagaccagatctttgagacagatatattcatgagccagaacaatatggccttcctctattttactcatctgccgaacatcattgataagggaaagcaaataatctgctgctatcttcatctttttatgattttcctgtatcagtgccttatcctcaaaatggttctcatcaatctttaacagaccaataataccattcaaaggtgtcctgatatcatggctcatacgactgaggaaattcgtttttgccctgctctcggcacgcatctcattgaatgcagcctgaaggcgcgcctgttcctgttcatcacgttcatgtctctgtgtggtatcctgcagcagaatgatcgcatagatcatagggatctcagcaaggatttctgtatcaaacactaccatactggtcataagcactgttttctgtacccatcggatacttccatcgtcttcgcagacacaatattctacagatatatgtgtttctccgttctcaaacctcttacgaagcttttcacaattatctgtcatgcagtaaccggcaattgtttcctgagtgacttttttctcatattcccagcagtaatcctgataagagtgcggaagcgaataatccataaaaagttcccggctcttctgctcttttccattcagtacgatccttctttccagaacatcctttgtcagatttactgtatagatcacatctgacaattccagaagcgcatccacatagctgtcattttccaagatagactgtttcaactgttcataataaagctgcaactgctcttttgcacctgtctgaccttcagaagtctttcggatagtttcaaatgccaggagaaaatgatgcagctttttatcctcatcccagtccaccggaatcaacgtcagacggttatatgccccctgttttccggtattatactcatattccagcacatcttccttcgtatgcatcttcctttgaagctcagaaatctgcagcccttcgcagatatctacctgacaggaactttcaacatgttcctctatgatctgttccactgctccggaatatgcaccgtcagaagccaggaaaaaattctcgctggaacgaatcgcccgataggtatccatcctggcatcacagtacaggcagtctgagaagttactgccatgctgattaagcagctttaacagctgatatccctgattcctttctgctgtagcctcttcccgtttcacatgatttttattgatatacatgtttttgtctgcgcagttaaacagttctctcattgtactcccgggaaaatcaccggccaatgcaaatcccaccgcataacttaagggtgtatccggatacactctggattcctctgtcatatctctgcgcaccttttcaagacactgtgtcatttgttccctgtccaatccatgggtaactgcaagaaattcatctccacctgctcttcccacaaactgctcagccggcatggaatctcgcagacagatagcaaatctacggatataggcatcaccggcttcatgtcctctgctgtcattaatacgccggagattattaagatcaaaactgcatacaccgatatctgcatccggttcttcctcattcagcaattcttcacatttatttttgttcggaagtcccgtcgcatcatccagatatacctttcgctgcagcaaacggttcattgcagcatattgtattgctttgataaactcatatccgatcaatagcatcaatacaacaatatctgccgtgatatatttttcaagcaatgataaggatgtggcttttttctgcgaatatttttcggccagacctgttgcttcatcacagattacaaagaagtcctcacttctggatataatatctgttttttcatatccttcagaccgccccaaacagatttcgttatacaggtcagaaaagccttcgtccagttcctgcattttattctgaaaatccttatcattcaaatataccagattcagtttggtatttccatcgcgcagaccaccaatgaaagaccttacctcctggatcattgcatcgtcctgttccccggcaacctccagcttgatgatcctctgtgtctctccacgaactaaaccagtataatttacaatacgggccgttccctgaatatcagaaacaattctcatcattataataataaggatagccagaataactgccagaacaccaatactgacctgaataatagtggatttctttttcttattctttacttcagacatgctcctcccccttcttgttctattctgtaaaaaatgacctgaatgaaccgatatcccagatatcctgatatagcgcctgccagagctccgccaagaacatctgtgggataatgcacatatcttttctcccattttttcagcatatgcattattttaccctactttctcctgtatgcctactcaaattttaatgtatttactataaatgagcaagttcgtgattttacataaaaagaaagacaccttaaatcgttcatgttgtataatgaaagtgacgaaacacacattgcaacattcacgaaagaaggtgcctctcgcaaattcttaaaatataaaacaaaaatacacccctgtcttacccttacacaggagcgtattctacatttctatttttttatctcctctgtctcgataataaaccgtacacttccgctctgcccttcgtaaatgcctccaaagttctggtactcggcatctacttttttaagacctcgtatctttgttgtcaaatttgtcaggtcatcacctgcaaggtcggttaatttctgaatggcttctttatcaaactctgcaaatccttcatctaaagctttcatcccatctatcaatgcctgataaccactgtcgagagcacttccggcactgcttaactggtctgttccttcacttaaactctgaccgcccacatatagctgaccgattccatctgaaaatgcactgattccggtgtttaactgactgcttcctttggcaagctgctcggctgcattttgaatcgtctccattccttcctgcaaggtctgcatctgttccggaagtccttcaagcaattccgctgcttttccaagtgcctgcatctgagcctgcatatccgtcaaaatcgcaggaagggcactggtatccacgcttaaatccggaatatcaagcgccggaattgaaagtaagatctgcaccgcctcttccgttttttctctggcttcttttgtcagctcggtatctttatcgttttcctttaactggttttccagactgctctttaatccctcttttaaaatttcctgttcttcttcacttaaagaagtttcctgcatcgtctcattaagagctgcctctactgctgaatctatctgtgcttccctctgcgcctttgcatcattttcaattgcatcccagtcaatcgctcccaatgtattttttacagcctcaacatcgttttgaaccgttgtctgataagtcactgcctctgtcacaaagttttcaaccgtttgaagctgagtctgtaattgggtcagggctgtatttaatttctggtcatctgcaactaatgcgaccattgcattttctactccgctaaaatcaaccccactctgaccggaagcatttccgaatgaaatcgctgacaagctgtttgaaaattggcacaatccgtctgttaatgcctgagctccgcttccaagcgccgtcttgttttcatttaatacctgcattccactctttaagtcatccactccttcttttaaagagtcaactccgcttagatactgcttcatatactcatcatagattttcatcccatctaaaagcttgccactgccgtcttttaattttcctgaagcctcttgaattttatccatgttatcggaagtttcatccaaatcatcgagattctcttcatctaaatcactcagcaatcctgatgaaagcacggtcgctgtaaaatccagttcaaaatccgttacatctgctgtcacttccacatattccggaagctcaatatctttcgtcagctcagaatcggagagattcagattttcggaaagtccggggcaggcatagccaataatcaaattctgtccatccaatgaaataacttttccattttttacttcgatatttgttgcattatcctctgataaaagcagggcagaaatcgctgcaaacggaacaggaagttccactttttttccatttacattcgtctcttctttggtatgattttcataatcaaaacgaatcttaagtgagccgctttttcctgccagctcttttggactgatttctttatcatccagaaaatagctgatttgaactgttaccggaagctgttcactgctctttccttcatattcaatgttttctccctgattgtcccagagaattgttccatccgattgtctggtatattcttcgtccccttttatatttttgatatcggtcagattcgaataatcctgaatcttcttctcatttttattttttaaaactgtatttacggtaatctcatttactgttccgtccgcatctgcctttgcatataccgtttctgttttatctttttctccatcggactgcttctcactgctttgttcttttgtatcattatccttttgagactttgtttccccctgtgtatttccagaggttttatccacattttccttatcggaagagttatccacactgcaggcagtcagtccaagaaccacagccgttccgattccaagagattttttccacaatgcatttcctattttcttttccactttttctcccacctttcactctacatttttcaaggcttcttccatcggaatctttcgcactttccgatattcgatgactgcaactactgcgtaggttaaaattccgattgcaaacatttccggaaacagtgtcggacttacataaaatggaatccatccgctcatacttgtcatcatcatctgataaaaaatgatttccatcaaacttttttccagcggaagcgtgataatcagaagcagtgccgttacaatcgaagttggtataatgtaaagtctcgcaatctctgcattgctgtaacctaaaatttttgccattgaaatcgactgcgcatttttctcaatgacaatcttagaaagcagatagatgacaaccataaagatgacaatcgcaaaaccatccaccatatacatcatgctgcccattgatacagtaagctgtcttgaaatcttcgttaaactttccaaatcaatcacagacgaaatatatttttcatcaatatctgtaatctcactgtctgataaatatccgctgaaataatcatttcccaaatcaaaggttcggttcaattgttcgattggcataaatacgcataaaccgccctcataatcataaattccgcctaccgtaaattcatactgtgtatcttcatagctttctcttaatgttatcacatcgccttttttcactttatacttatcagagtacgctttggaaaccagcacttcgtctccatctgtatcttcaagtggaatgtaacagctgtccgactttactccatagagcataatttcatcggttttatactcactatccaaagtctttaaagaatacgcactaaatttttctgcatcttcattgtccgtctgaacctgatactcaaaatacattaaattcatcaggctttctaatttatgttcttcattcatcgcatttaacggtatatttaaaatatactgataattgcacaacagattcttttcgatttccgtttgataatgatttaagatctgcggaagcatcaacccaaacatcaaaagcaggtttgcaaatagaattccgactgtaagcacaacataattgctgacattctggaaaatcacacgaagccggaatcttgagaaaaatggaatcctggcactcaacggtaatgtatatttttgttttcttttctttaaatcccttcttaaaaatttgagaggggacaacgataatgttctttttaataggaagaaattaatcactgccatcaaaaaaaccggtacaattgtcgtcatcacaaaggcttcaccgttccataatgtcacataagtcggcagactgtagcttccataatacatgcctgcgcagacatttttcagaaccgtataacctaaaatatttccgatcaccgctcccgcaaatgtaaccagcatcggtgcagtcatatagtgaagaatcagttcccgtctggtataacccgaagcccttaatgttccgattactgtagactctttatgtatcgtattactgattgtaattccaaatacaaaagcaagaattgcaattacaatataaagcaggataatcatcatcatacggtcactgcccatatcttcaccggtaaattgaatcgcctgattactgtaacgtggaacaaatgtttcaaggctgacttcactatttaagactttcataaaatcttctgccacatttttttcttccgtctcaccttttggttctgttccatatttccaggaataattacaaatcatgttgtccgtactaaaagaatcaaacgcctcctcagttacaattccgacaccaaattttaccgcatcaaacattgaatcattattgtccgaaaacagacagctataatctgaaagcgccacaagccctgtaattttccactctcttccactttcctcttcggtaatgatatctcctacagacagttcattgttatccgcatacatacggtcaattgcgatttcatctgctgattttggaaattctcctttcatcaggcagacacaattaacttcttcacgatttttaaaaattcgcatcgtacttccatttgtcagcaccggctctgcataaaaattttcatacaatgtcacatctgactttgctatttctttctgctgtgcacggttcactttttcttttaccgtgaaattcccatcttcaatattatatttctcaaaactttcattgtaagcagtcagcatacttccatctgctacaagaaaaccagatacaaatccaataatgctcattaacagaaagaaaataacaaaatatttccctgcctcacctttcagctcacgaaacagcctctttcttaaaggatttttcattttttcctgtcactcccctatttcccatttaccactctaaatcctgggcacttacacgtgcttcattcacataattcttccgaatcattccatctcgcagacgcaccacacgatccgccatatctttgatggcatcgttatgcgttaccatgataattgtattgccatatttttgatttacggtctcaattaattttaagatttcttttgaagttttataatcaagcgcgcctgtcggttcatcacaaagcaaaatatccggatttttaataattgcacgcccaatggcagtacgctgctgctggccacctgaaagctggttcggcagttttttgcggtgttcatacaatcctaatgtacgcagaagttcttccatctcaagcggtttgtcacttaaatacgccccgacctcaatgttttcctgaactgtcaggtttggaattaagttatacatctggaaaatataacccagatgttttcttctgtataatgtcagacgcttttcattcatgtttgacattttttccccatcaatgcagatatctccactgtctgccccgtcgattcccccgatgatatttaataatgtagattttcccgaacccgacggtccaagtaaaacacaaaactctcctctgttgatttccagattaattccctttaagacctcaacaaaactgtccccctgcccaaaggatttttttatatcacgaatctcaagaaacatggtttgttttctctcccttatattagtttatactaaccattgtagcaccagatggttttttcataaataaaaaagaatgttttaaattagtctttgtcactctatattttttctgctataatgtgcgtagacaaaaaattatctattattcttaattttatggagggctttaaaatgacagtatttaatacaaaaggtgtctgttctcgttctattgaaattgaactcgacggtgacactgtaaaatcagtaaaattcaatggcggatgcaatggaaacactcagggtgttgctgctttggtaaaaggaatgaaagtagatgaagcaatctcccgcttaaaaggaattgactgcggtggccgtggcacatcctgccctgaccagcttgctaaagcattagaacaaatgaaaacccagaatgcataaagcatagaaaaagagtggttctgaatccttttttcagaatcactctttttttctaccatctcttttcaactgccggacagtgatttttcttcatcactgcccgcatttccacgaaacacccacagattcgacacattccactcagcagattatcacactccttacattttgcaaggcggttttgatactcctcatcttctacttttaagtctttgtctatctgtgcgatgtactttcgcaaatctgtaaaatattcgttttcatccatatcctgcagaagacattttctacagatttttctatacgatggctctttctctatctgtcccatttgtcacaaagcgaattaatctggtctgccaatcttgcaagatccttatttgctccgccctcattatgccggataactgcaagcagtctgtgaccggcagccacaagtctcgcataaacaccagatgccttgcgtgctttcgctttctcctttgcatgttctattatgataccttcggtctctttctccagcacattattcgccaaatcaaagaccgttccactaaacggagcgtaggtatcatagcccagttcatttttcagccgttctgcaaagagtgtacagacggtatcttctccatgtgtcacaaacacacgctgtggtttttctttaaatgcagatgcccagcgcatcaatccttcattgtctgcatgaccgctgattcccgaaagtcttacaatctctgctgatacatgaatttcttcaccaaacagtcttacatcctttgcaccctccaaaagtgcacgaccaagcgttccaactgcctgatatccaacaaacacaatcgtagaattttcacgccacagattatgttttaaatgatgtttgattcgaccggcatcacacataccacttgcagaaagaatgactttataatgttcatcaaagttaatggcgcgggattcatcacttgtaatcgaaagcttcagccccggaaatgcaatcgggttaattccctgattcaaaagttccattgcctcttcatcatagcagtctacataatgctctttaaaaatattggttgcctgcacagcaagcgggctatcgacatacacatcaaaatccggaaattccggaagcaggttatctgccttaattttacgaagaaaatacagcatttcctgcgttctgccgactgcaaatgaaggaacaacaacatttccatgtcgtttaaaggttcgtcttaagatatcaaccaattcctgcacatagtccggacgttctccatggcttctgtcaccataagtagattccatgaccacataatccgcagactcaaggtattcaggatctttaatcaatggctggtctgtatttccgatatcaccggaaaatacaatcttcttctcaacaccatcttccgtaatccaaatctcaatacttgaagaacctaataaatgtcctgcgtccacaaaacgaactttaattccatctgcaatctgaattattttatgataatcacacggaacaaactgctgaattacattcaaagcatcttccatcgtatacgccggaacaaactccggctgcccatttcttcttgccttacggtttcgccactctgcctcaaaggtctgaatgtgagcactatcacgaagcatgatatcacacaaatcgcaggttgcagcggttgcataaatcggaccgcgaaatcctcttgcataagccagaggaaaatttccggaatggtcaatatgcgcatgcgtcagcaaggcaaaatccacatccgacatcggaaccggcacatcctggttctcatactggtcaggaccctgttccataccacagtctacgagaaatctcttgcccgcagcttctaaaaagtaacagctacctgtaacttcatgagtcgcacctataaatgtcaacttcataaaaaaaccccctttgcggttttaattcaagtactttcaagatagtactattataccgcaaataggggtcttttgatagttttttcagattattttataaaagtttatgattttttcaaaaacagggttttaaacttttttacttaaagatacttaaaaatacaaattgtttttaggataaaaatacttattcttttcattcacagccggcaattcacggactatgaccttatttattggtcattaagataggagattcttgccgagtttaaaattgaataaaaaaattaatcaatccagataccgttggtgataggtacttgagattcagaattacccgatttttgtgctacacacgcagctttcacacgataataataaccaccagctactttcacattgtaactacgagacatagatgctgcattagtagcagtatcaccataagtaccataattcacccagccaccatcatactgctgcaatgtcaatttcacaattaatttatcacaggttttataagcaagagttgctccataaatattgaccgtacgatttccaatatttgtaatttttgcaattccctggtctaatagacttcctcttgcaacattctgccaaatagcttctgctgattcttcattcgttaaaatagaaccatctacttcttttcctaaatcttctaatccatctgctgatactgaaatagaagacacggttaagaatacagataataccaacatagctactattgatttttttaattttctaattactgatttcaaatgaagtctcctttccggattaatatacaatatctttgacgatttttctcatctcttcttctgtaatttttccagaaattcgataatatgaatttttatattcccattgaactaaataggttgaattttcactttcaccgttctgtattttccataattctggttctatatttgacatttcgcactctgcaattcccaagcagactccctcatcatttcgataaagtccactagaatcactataatttgcctgtataataaaatacatataatcaacaccattataatatcttatatatacagactgcgcagtttcatcaatctcataagaatcaaaattcattcgattcggcaaataaaaaaaatgaggaacttccatttgaagtttttcctctatctcacttctagctttctcttctgttctgtcactaatcaatctatcttgactattttctatttctgtatttttctcatcccccaacacttcattcgctttatccataacataactcctgcctccttgtgtgctcatactcacaccaaacaatccaaagcaggttatcacagctgcggcggtcatgccgaggaattttttgcttatgcggtgattaaagaatttaaccacttttgtattctgattttcttttgtgttttcttctgtagatttggtttcatcttcaaggtgttttgtgttttcttcttcgagcagcccctcatcccgagcttcaactaccagcttttgaaacagttcttccggtggctcaaaatcatcgaacctgtcatctgtttccagacgttttaccagctcatctgcttcttttcggaactgttcttctgcccaggtactgctttttgcgctgttttcttcgtttttattcatgaatttcctatcttttcttgacttttcacaacgactgtatcatattatctaatagacgctgcaatgtccgtcttattgaatgttgtacatcgaaacattgatttttgatttatcaggaggttccaatgaaacatattgtgctcaccggtggcggcactgccggacatgttacaccaaatattgctatgattccgagactgaaagaactcggttacaagatttcttacatcggttcttaccagggtatggaaagaaaactgattgaagaaatggggattccttattacggaatctcttctggcaaactacgacgttactttgatgtcaaaaactttactgaccctttcagggttttaaaaggttttcatgaagcgaaaaaactcatgaagcagttgaaacctgatgttgttttttctaagggtggtttcgttaccgttcctgttgttattgctgcaggacgtcgaaaaatccctacttttatccatgaatctgatatgacacctggactggcaaataaactttccattccatttgccactaaagtgtgctgtaatttccctgaaactgtctctgaacttccggccaacaaagccatacttaccggtacccctatccgccaggaattattaagcggaaatccccaaaaagcacttgcctttacaggtctttccagtgagaaaccggtcattatggtcatcggaggaagtctcggtgccgttgcagtcaacaatgcagtacgtgccattctgcctgaacttttaaaagacttccaggtcattcatctttgcggtaaaggtaaactggactcttctttaaccgataccaaaggttatgttcagtacgaatatatcaaagatgagcttgctgacctttttgcactggctgacatcgtcatttccagagcaggggcaaacgcaatctgtgaaatcagtgcactgaaaaaaccaaatctgctgattccgctttccgcacgtgcaagccgtggagaccagattctcaacgcccgctcttttgaaaagcttggttacagcatggtacttgaagaggaggaaattactaaccagaaactgttagaatccatccagactctttatcagaaccgcgattcgtatattcaagcgatggacaaaagcaaacaaacggattctattgaacagattgtccagttatttgaacaggcagtcaacaaataattatttctcctgtgccggcatttggcacaggaattttttttggaaatctatccacaagtattgttctgccggattcactggattctgtttttatatatcctcgtatttgtctccatacgttttttctatccacttgttcatcctatgttttttaactcttaagttttctatagtcagacccagagcggccgccatttctgcatccgttgcctgttcgtaaacctgcatcgtcataatttcgtgccactgagggttcctggcgtacagcctgtccataaattctgtcgtgaattcccgcttgataattgcatcgagcaggtcttctcctgttgttgcctctctatgataaattaacctttctgcgtgttccccttttccattttcacacggctgttcaagaacagtcatctcatgttttcgataactttttttgaggaaatccaacgcctttcttcgagcagttaatgccagccatcccgcatagtcttcaggacttaccttgttccatttctgtatcagcttatggaacacttcctgacagacatcctgcgaatcatcgaaatcttttaagacatcataagcggctttcattaccagtcgataatacttgtcataaacttcacgtaatttttcctctgtcatcttcacctgttaattcatctgaatcttggaaattttttcgaggatttcatttttatcctcttctgtcaatttcccaggagtccatgtcactcctacgtggtcctcattatttcttggaatcagatgaatatgaaaatggaacaccgtctgacctgcggcttctccattgttctgtacaatattatagccgtcacagcctaatacttcagtcattgcggtgatgattttttttgccagaacaattgcttttcctgcaagttcatccggaatttcatatagatttgcatagtgctccttcggtaaaatcagcgcatgacctttacttgccggtcctaaatcaagaataactctgaaatcattatcctcatatatagttgctgacggaatctctcctcctgctatcttacaaaaaatacaatctgacattttaaatctctcccttctagctgtcattgtcgaattttcaaatattttgtagaatgattttatttgctatttgcctataacggtgctacactatcaagaaaaaaagaggaggtaacaccaaatgacaaaatcatctgctacttcacagattgaaggcaaaaataaaacaattgattacaaaaaactttatcaggaacaagcgaaaaaacatcagctgatgctttctcagatttcccacgaaatccgtaatcctgttacacttatcaacagttttcttcagattctggaaaaacagcatcctgatttatcagaagaccaaaactggattaaaatcctggaaaatatggattttctcagaggtctgcttggtgagctttccagttacaataattctctcagactgaaccttgaatcaaccaacgtctatgcattatttgcaaatgtaattgcatccattaatccaagtctggaaaagaaaaacgtttctattgcttttaataaattgtctccaatccctttattgtatgttgaccacaccaaacttcagcaagtgtttcacaatctgcttcgcaatgcatttgaagcggttaaagagggtggtcatatcgtctgttcaattgaatcagacggtacaggtgtgacatttaaggttaccgacgacggatgcggtatttctcctgaataccagaactctatctttgaaccatttgtcacttataaaccggatggcagtggtctgggacttgcaatttcaaagcggattgccgaagcccataagggaagtcttgaattcacctcaagtcctgaaaaaggaactacattcatcctgaagattccgattctgtgaaagcagaatcgttgaaatctttgattattctaagttactctgattattctaattactcttcattctgattagaattttttaagtcctctgccatttttttgtcctctgtaaattaatactgcaaggacaaatccacacaagaatccgccaaaatgtgcggcattgtcaactcctgtgcttgttactccatgatataaagttaaagctgccaaaaataacagcttctttgtcgtaaaattttccagtctgcctttatttctgattactacataaatcaatgcacccactacggcaaaaattgcaccggatgccccggcagacacgacgttttctcctattcgcatctctgacagataagaaatcagactggctcccattcctcctgatatgtaaatgaacaggtatcgtacccttcctaccgcccgttccagacaatctcccagaaagaataaaaccagcatgttgttgcccaggtgcgtcagaccaaaatgcaaaaacatacaggtaaaaaagcgataatattcatgcccctcctgaatcaatggtgtgtatgccgcaccccattgaaccagatgttttccatcaagtgaagaacctgtcaactctgtcaaaaagaacactacaatattaatcaaaataatcattgtattaaccggcacttcttttcttccctttaaaaattgaaggatatcggggtcaattttctgtactatcttttgcttttgcatcttattttccacctttgcaaggtataaatttgctttttttcactctttttatactcctcccctcatttttttcaatcccctcttggtttatgcccattataccatattttccctgttttgtgcgcttttttcatcgccaaaaaacgacacctttcgccatttttttgaaaaggtgtcgtttttataaataatagcttgttttatttttcaagaattttctttaaatcttcttccggtgtgccggtcggtgagatctggaaattttccaccagatagtttaatacgttttcagaaacaaaagacggaagtgtcggtccaaggtaaatattcttgattccaaggtgtaacagtgtcagaaggatgctgactgctttctgttcataccaggataataccagtgtcaacggcagttcattgacaccacattcaaatgcttccgcaagagccagtgccactttaactgcgccaaatgcatcgttgcactgtcccatatccataattcttggaaggccttcgattgttccaaggtctaagtcattaaagcggtattttccgcaggcaagagtcagaataatagaatcttttggagcttcttttacgaaatccgtataataatttcttccctgacgtgcaccgtcacatccgcctactaagaagaaatggctgatttttccggcttttacagcctcaatcacctgtggagcagcacctaaaattgtatgatgtccaaatccggttgtcagttttgttccaccattgattccggcaaactgcttatcctcagaaaatccaccaagttcaatcgctttttcaatcactgcgccaaaatctttttcttctccatctacatgctgcatgcctggataggctaccacacctgttgtaaatacacggtctgcataactttcttttggcggcataatacagtttgtggtaaataaaatcggtgccggaagattagcaaattctttctgctgattctgccatgctgttccaaaattaccttttaaatggctgtatttgcgaagttccggatacgcatgtgccggaagcatttctccatgtgtatagatgttaatgcctttgccttcggtctgttctaagagcatctttaaatcttttaaatcatgaccggaaattacgataaatggtcctttttctacttttaaagaaacttctgccggtgccggaattccataagtttcggtgtttgctttatccaaaagttccatgcatttaaaattcactgcaccggtctccattacgataccaagcagattttccatggtgcggtcctgtcctaaagctgacatacctttgtagaagaaacggttcacttcttcatcattatagccaagcaccattgcatgataagcataagccgcaatcccacgaagtccgaataataataatgatttcaaggatttgatatcctcatccggctctctccatactttttccatttcatagatttccatgcgtccacatggagcctgacaagctgaacatcctgatgcgtaaacctctttttctttcagggctgtttcgattaatttttccaacgcttcatcatcaaagtttacattggtaagagttgcaaacaatccttcaatcataatacgatttgtcttttcagatacattctgttctccgactgcttctgcaagcgcaaccagacttccggttaatttgtcctgaaggagtgccgttttactgctctttccacagactcctcttgctcctgtacatccactgcatcctgctctctgctcacactggtagcagaacatttcttctgttttttctattttgctcatcttctattctcctttagctgtttcacttattttttcaaatttcttgtttctatggttagaatatactataattaaaataattattctgttgtacttccaacaaattcaaggagtttatttatggaaaaaaataataatttaaatgaagcttttttagaagtgcttgcggagtctccattgtttcgtgaaatcgaaaagaaagaacttcgtgccatgttagtctgtcttggcggtcagataaaagaatataaaaaagggacttctatcttccgctggggcgataaaatctcaaaaatcggatttgttttaaagggaaatgttcacgtgcttcgggaaacgtactggggaaaggaatctctgcttggacggattggtcctggtgatttgtttggagaagtctatgcctgtctgccggatttggaatttgacggaacagttgtcgcccagactgactgcagtattttatttcttaatttaaaccgcacgattgctacctgttcctccgcctgccattttcacacgcagatgatttctaatctgttgcagattcttgcacagaaaaacattgcattttcaagaaaactcgactgcctgagccaccataccatccgtgcacgacttattgaatatttctcaaaacaggcacagatttgcggaaattcttctttttcgattccattaaaccggcaacagcttgcagattacttgtgcgtagaccgcagtgccatgactgtagaattgtataagctaaaagatgagggaattttggattttgacagaaataaatttacacttttagaataaaaaaaggaaccttgtcactaagattcctttttttaaacagtttttcaatttcaattctatttttaagctattgctgttttactttctttttttggtttgtaaagcggacattcgcaatccgcttcgctacttgctcatgaacgcagtcgcttcgcgatctgtcagtgggagctttcaactctcactgacagaagcatccccctcacccaccgcttagcgctctgcacacttgaagcgggggaatgcttatctgcgttcaagtaatttcttgataccctgaattgctactaatacaccaaggattaacagcagaactgcgaagataagctgtaagctgtttccaaggtctaagcctgttgtcataaatgctttgcttaattttacgatagtcatgccaagtgctgtaaatgtaacagccatcataaataccatcggtccccaaagcatgaagccctgacgttttgttttctttaagaatactgcgcaggctaccagtgccagtacggataacagctggtttgctgaaccaaacaacggccagatttctgcatatcctacttttgtcagaaggtaggcaagtaccagtgtaatgatagttgcaaaatatttgtttgtcacaaattttaagaatggactcatattctcttcatctacatcggcatcaaggaagaattcctggaaggacagacgaccaactctggctacagagtccagtgaagttaatgcaaatgcagatactgccaggttaatcaaagtaaataccaaggagtgtggcagaccgattacggaaaggaagtttgcgattgcacctgcgaaaatctgaggctgagttgtcagtccctgtgctgctgcttctccttttgcaaaagatgcaactgcgattaaggcgataactgcaagcatactttccattaacattgctccgaaggataccggaagcatatttttttcatttttaatctgtttggaagcagtaccggaagagaccagtgaatggaaaccggaaaccgcaccacaggcaattgttacaaataagattgggaacatgtactgtccgtctacgttaaagcttgtaaatgctgcaagattgcaggatggatttgctacgaacacaccaacaaccgcaccgacaatcatgaagattaacaggtagctgtttaagtaatctcgtggctgaagcagtgcccataccggagcaacactggcaatcatgatatatacaaagatgatgatgtgccatgttccaaggcttaagtacatcgggaagtttaatcccagtgcaattgctactactaataataagacagccaccgctgtattcacccatttgttaaatcttgtgtattttaagaacattccaagtccaacggcttctaagataaacaacatagaagtggttgcaactgcaccgttagctactacttttgttacttctccggcttcgtttgctgcaaatccgttaaatgttccggctacaacatcggcaaatgccgcaacaaccagaatacagaataaccagcagaataacaggaataactttttacctaattttccaatatattcttcgatgatataaccaattgtacgacctttattttttacagatgcgtacatggatgcaaaatcctgaacagctccaaagaatacaccaccaattaaaatccaaagcagcaccggaagccatccaaagattgctgcctgaatcggtccattgattggacctgcacctgcgatagatgcgaactgatgtccaaatactacgtttgtgtccgccggcacatagtcaactccatcttccatttcataagcaggagtttttgcgtttgggtcgatgccccatttgttttgaagataacggccatacaggagatatgcacctccgagtactacaatggcgattaccatcattaagattccactcatagctctttccctcttctcttaaatttattttttaccaagttttgaaaatagaaataaatttatctataaaaaaacgcccttgctatcctctcggataacaaaggcggaattttctttccgtggtaccactttgtattattgtacctatcgctaactacaatctcttaccactgtcttttttaacagtctcttctgtaacgtgaagcccacgtccctgcctactttcaaagttttcaaagcttttcaatacgtttaatctctcaaagctttcatttcagcgggatgctctagggtgatgtcacaaaacactttctaccgtttcacacctgccaacggctctctggattccagttctcttttgtgatgtatccctttcactgcatttccttttcttaatttatgttatgttttactctttttttatttaaaacacaagagtatttttcaacatattttatagtttcgtcgatttatttttgtgcaattttcagataacaccttttattttctccaatttggcaatttgatagctgttttgggatttaattccagtcatcttgttcttctgcttcctgcactttttttaatttttcttctttttgttttttattattatgactgtttcggattacaaacacaacaaccacaatcaagataagcgcagccagcgcaattaaaatttctgacaactgtcccattttagaatcagacggttccgacacgcttattgctgtctccggtgcatcacttaaatcaaacagggtattttctccctgctgatatcttttataactttcaagcgcataaagcgtctgatatcctgccaatgcatccggcgcattttcattttcttccagagaatgagccattcctccatcctctgtccgaaattgtaaaattccgtctaacaggctgttttcttcttttaagaaacgagcatcttctaatggattgatgccattactacacacggcaatcaacgtccagtctgtactttctacactttctacacccatagatggcattgctccatctgcctgctgctgactggaaagccaggaaaatccattttcaattgccgtactcactttttcctcatctttatacggagccagtgctgtgagtgccattgctgtgatatccacatcggaatctccatctgtggaaagtgaaaatcctccatcttcctgctctttttccagaatcgcatccactaatttttcacgattccagacagcatcttccggttcttcataatctttactgtctaatgcaagcagtgcccagatataaccatttgcaccctgtactccaggatcttgattttcaaacacacagtcaaaaatcccatcttctaccagattgatttcttttttatctttatctgtgccaaaagcaagggcatctcccccacaggcatttattgtcaaaatttcccggtaaaaatctgtcggattcatgtgctgttcttccactgtttttgtaatatcatcttcatacagtgtttctatctgttcctgcagtgcactaagataaccattttgattatccggctgtttcattctgctgactgtaaatgcaagccagtctcctgctgaagttcccgcactctccagtactacgccatccagaagatttttcccatcaattcccatctggtctttttcccaggaaacaattccatcctgaatggacttaatttcatccacctgatacttctcgctgtctgcctgtaccggtactgcccctcctacaaacagcactcctgtcataagcagagtaaacattgattttttcataaataagttcctctttttattttacacatactatttatcaatacttcaataaaattttctttcgtttctttgagccaattaccatgaatccaatacctgcaagcaccagaatcacaagtacaccaagcaccgcacataaaatctttactaccctgtaattttgtgctaccggtgcactgccttttgccgtgttttcttctccattctgcatgcttacaccggcatctccttcttctcctgacaaaagtgcagtttcattttctgccgaagtttcttctccatccgcattttctgcttcctctgccttcgcctcttgattctcttttgcagtctcctcgattttcttttcctgtgcctgttctccgttcttagcattacctgatttttctgctgcatttcctgatccagttgcattagagcttccattttgtttcgcatatccactctcatgcgcacctgcatgggaattagctgtttctcctgctgccgcagtattttttatctggctggtttcatcactcttgtttaagccctgataagcggattctgccttttccaaatcgctataattttccaccagtgatttttgtctatcacttaaactattgtaagcatttcgaatttgctcaagcagagaaccactctcttttgtcaccactccgatttgagaaatctttgtgctgacctgatgcgccgctaataaatcagaatagttctgataagcctcttccaacactgaataattgctgactaattcctgctgttctgcggtgagtgcattatacgcttcgattgcacgggtaatcgcgccgcctttttcaagcgtcacttctccgatatttttaattaattcgatgaccggactcgctaaaatcaggttctgatacatcgcttttgcattttgaagctgcttatagtttgtcactaatttcttctgattgtccgttaaggcatcgtataactgctgtgccttatagatggcatctttactgtttaaggtaattgttccggtcaaaatcgcggagatttcagcggaaacttcctgtgcctttaacttatcataagtctgttccgcacgattcagatattcgggatgtgccacaaggctctgctgtttttttgtgagcgtatcataagcttttcttgcctgtaaaatcgcatcttttttgtctattgtcacaggttcaagtttatttatcagctcatccactgctgatgctgcctttttatcagcttcatccacttcactttcttctaacaggcgggcatattctttttcggctgattctaacacatcataattgctgacctttgcttttaattcgtctgataattcgtcataagcacttcttgcaagattaatgtaagtcttactctctaaattgaccgttcctatctgattaatataagcttctaccgcagaaattttctcctgattttctttctgggttttctgctcatctgtctcaagacggtcaattctggatttcacatcggcaagtatctgatttactttttcaacactgtctgcctgatgcagatatttcactccatcggaaacataagtttcaagctgaattttttccgcttcacgatatgcagtttcatccgcataattctgcaattcttcaattgccgatgcaatggctgattctaactgtttttgttcggcttcttttaaggtttcgatttcataaatcttctgcttactgtctgtcagaatttcattcatttcatccatactctttgcagactgtaatttttcgacgccttctgctatcagagccgatacctgtacccagttttcttctgtatattcctctgcttttacaaaagtctgtaaatctttgactgcccctgcacggaactcttcgagatttaattcccattttaaaatcggaaatccatcctgtgtgttcatataatctttgataaaatgatttcccgatgcaagcagtgcatttaagaaactctctgttttcatcttatccgcttccagatattccccggtacttgcacttccgtttaataaaccaactaacggaagggaggcatttgccggatttttgagcgccgtcagattcgtataggttccatctaacattgctccaaagagtgccccgatacattttccactgatattcaggttcacatctccaatgttatagcaacaggaaatctgtgaaccgcctgaggcaccggtcataacaccaatcagaccgcctgcataagaatttgccagtacatctccggtattatagttggatgtcactgcaccattacttccactcatacgtccaaccagtccgcctgcacaaaactctgcttcaacactgccacggttgacgctctggcgaacacttacagaatttgccatatctccaataattcctccggcatagaactggattcctccggcactttccagactgacatttcctttatttgagcactggttcacccacatcttatctgcataaccgacaattcctccgactgctgaacgttgacgttttgcatttttcacctgaatctgcacttcactgtgacagtttcggatataatttcgctgactctcattttttccatgcatgtatgccacaattccaccggcataagcaattttttcgctacattcaatacttccctttacgataagattttcaatgctttgcttttcgtcgccatatacgataccaaacagaccagagtatgtgtcaccgctttcgattctaagcccacgcacaacatgatcctgtccatcaaaacttccggtgtatggaatcttagaactgcttccgattggtgtccagttgtgatttccaagattaatgtcatcgcacaattttgcatttgctttcgcccctgttacgccggaattcaccagttgtacaaaccacgcaagttctgcaccgtttgaaatctgatagtatccttctacaagttccggttcttttgtgctctttccgtcccatgcaccttcctgcggaatattatttaaaatctcatcgatttgtttctttgcctcagcaagggcagaagcgacttctttgctggttttcgctgactgaatctgtttttctccgtctgcttttgccgtttcgattttatttttccaggtttcctcaaccgtaacatccgaagcataatttttcagttcttcgattgcagacgctttgatttctcctaactttgcactttcggtatactcgatggacaattcattcaaacggtctttcgcagtttttaataacgcttcgacgtcggcaatggtcagggcattttcgatttcatcttcaaattgttcttctgtctgttttagctcggcaatctgttcctcactccatttttcactgccctgtaagagttcttcctgatactgtgcaagctctaagattgcattatttcttgcctctaacaatttggaatcgacttccgaaccaggtttgattttttgaagggcttctcttgcctctttcatgacgctgtccaaatcatcctgagtcacaaccgaatcaattttctctaaataattttccactgtctgttcgattaaaatataagttgttccatatttcttcttattttcctcgctttgccagccctgtaattcttcaattgcagaatcaattttgctctttaaatccgtcgtctgttcctcaaaagccagtttaggatacccgcctcccgcatcaaaaatacttgctttaataaaagcagaaccaagtttcgttatcattttctggcttttcattgttttttcgatataaagacccgtctcgtcaataatttctgtcgttttatcttctttaaaagagtataaatccagattgtaggaagaatcagctcgaagtgcatacacgcgtccgatttttccacttttaaaaataccgataattgcgcctctgtattcaaaggttttattcgtatagactgcaatgttataggcatttttaatgactggctgtgccggattctcttcttctttggtatcggcataacccagtttaccgacgattcctccgacaatcgttcccgtataggaaaccaatcctccaagttctccctgattgtaaacattttgaatcagacattcttttaccgttccatctgcatagacactgctttcattgacaccaccggcaattcctccaatcgtatccactccgctgatttttgctttattgtaacaattctgcaccgccgcgccctgatagactcctccggcaattcctccaaccgaataatacccctgcactgcttctttattttcgcaataacgaatgactgcatttggtccgacttccattccggcaattccaccgatgttatgctgcgcaaatcttaccttggtagaaagcgttccattattgacacaacgtctgactgtcccggaacagattccgacaattccacctgcattacgacgaagggcttctcctgccatcgtggtttccgtatagttggtacagccggatatggttccgctttttaaataaccggcaattcctccgcttccgatatagagtttttcatactttccctcggtcttataagccgcataattattatgaacttctccggatacttttacattggaaatggttccaccatcaacaacaccaaataatccggcataacgcacgtctggattttcttctgaaatctcggcatctaaaaagtataccgtatatccatttccgttaaatgttcctttataggcatgttcggcagtatcgccaatcatcagccatttattttgagacgttccatcacccagataaattttatccgtcagttctccgtttatcgaacttgcgccgtcatttactttctttgcaaaccacgcaagctctgctccgtttgaaatctgatacgttccattttcatcggtttttggaacttcggttgtctctccatcccaggcattcataatttttgccgcctgtacttctctttgtcccatgacaggaaccagagtcatactaactgccagggcaagcacccatgccagcagtttctttccataacttttctttttcattttgattccaccttacaggaaataaataaatttcaactggaatcgttccagccatcctgcttctttgtaaactttttcccagaccttattcttaaattccataacaaaatctctctgttcttttgctatgctgtggctgctgtaaacggcttcctgtctgatatctaccaccttggtatattctattttcatttcttcatcaaacaagctttctatctgacttccataacgatacaaggaagcatttcgcactttcaaaccaaagactgctaaaatattcatggtatattcaaacaatgcattgactgcctgattataatcttcactgtcaaataattgttttatcttctgacagcgaatccgctcacggatgatttttacaataattaaaatcaaaaacaaggtaatcagtacaatcaagataccaagaagcatttccagtatcaaaatccagtcaatctcatcttcctcttcttccggttgttcttcgtcctcaagattatcctgttcatcctgttgttcctgctcgtcatctgctccgatacccgaagtaattcccgagatatcctgatactcttctgcggtctccataattccaagataggaaggagtcgattcaaatggaagccagccaactccatcctgataatattccacccatgcatgtgcatgcgttccatctacggtataaggctctccggctttcatacttttgacatcgtccggtgtaatcacatacccctcgacatatcttgccggaattttataataccggaacatcaatgctgccgctgtcgcataatgcacggaataaccttttttggtattttcaagaaaattcgttaaaaaatccaaatctccggtttcttttttgatttcttcactgtaagtacagcgggaactcaacacatataaaatattctgtttcgcctttgtataatcaaaatgagtactgccatttgcaagggtatactctccaagtacctcttttaattctgtctcaacagactctgggagttccaaattggtctcatagacatattgattataaaatgcttctttttcactgtacgcttttccctcttcatccagattttctgtatctgcaagttttgcggtaagagacggatattttttaatctgattttccaacgccgtataagtatattttcgctgtccctttaagccttttgcaataacaccttcatctccgattcgatttttatcaggcgttgttccggtaagttcataaggtgtgtacagataacggctgtcctcttttaagttttttatggtgacagtattttccggttcttcttttgtcgtctcatctaaagctaaagatgcaagcggtaaggtttcctgtccgaaaaatctatcctgatgcagccagtaaaataaatccgaagcgttataaagtacttttttatcggttgtttcccaaccatgtttattgtaaacactgccggtgtatcctcttaaataataagactgtgggtcgctcattgtcacttcaagcaccgcatcatcttttaatttcaaagaagaaagtccttcaaaatctccttttggcatcgcatcataacttccaccataccgccagtcttctattttttcttttatcgaagcttctaacttgctgactgtttcatttttggagtattctttttcgggcacaagcagcatgaaaataagtgttacaaacaaaatcatacctgctgtaaaacaggcactttctatttttaaggcactttctttgcttccggtttcctcttttcgatgcatccgaaaccatatcaataacaatgcacctgaaaatacaacattgaaaacaaacgatggaccaaatccgagcacaatctgtaaggttatccacataagtccaatcagaccggttatccaccggttttccatcttgataaatacggtacttatcttttcgataaccacaaccaataccgccatcgtaaccgaaagtttccacttgtctgacagatctccacctgataccggatactgcggataaatataaggaatgtgctgtttgatttcatctaaaatctggtttaaaaacagattccatccatccagtatcattttatgaaagaggagaagcaccagtatcagcaccaaaacttctgcaagcagtgcatattttttcagttttcctttccactcagcttcaaaagaaagatacaccgcaaacacaactcctgcaatggcaggcagtgcatttacctttattccaaacatgttgcagacggcgatgcctgtcagcattgcaaatatccataccagcagtccgtctatgaaattttctattcttttttgtttttgatttttttctgtctgtacagcaacaagcagaattcctgtactgtttttttgattttttttcatgaatcgaaccacctataattttttctcttgcttgcggaattttccacctatatttcaagatatgagagttccgcttcggcattttctgtcgatacggaaatcacatgcgccccttcctctgtaaattcgcctctcggctctttctcacaaatcacttccgtcaccagacaccgttctgccaaagccgaggcatctgccgtcagatatggagtgaatagcaccagatgtgcaaactcacattgttctctctgttccatgtaatgaccgagaaccgaagttccatcttctcccggaaccgctgaaagaagttccggaagtatcattgtaaattcttccagactgtcaatttccgcactgctgtaagtctgctctttatggttataccagccaatactatgtacaatctgctgttcgcacatttcctgtgaaaccgataccagacattctaccagcttttccatctgcgatggaaattcttcgcttttttccggatatccggtctctagtaaaagtaaaatggtattctgcaccgggagtccataatctcttacgattaatccatctaatttttctgaaagtttccaatgtatctgatgaatgtggtcacctgcacgatattctctgactgcaaatgtttcacttgggtcaaatccggctttgctcatggaatattcttcggcatctagcactgcattttccccataaaccacttccacctgaagtccaaaagtattcggagtaatcaatgtcattttttcagaatctgctagaatttttgtttttctaagtccaaaataatccattaccaaaaatccttctaagcccagacaaagttttccgcagtgcctgctttttaattgtaactgctgaagtgtttctgtttttgcgggagcagaagctaaaatctcatactcttctgcctctcctgtcagcatgttttcgcattttatctttgcaattattctgtcaaaggggaacaaacctgtattcttaatctttaacatggctgtcatgtctttttgtttttcacccagattgtctatgcctaaagttccgaaaagtttttttgcacaaatctctgcccctatcatctcaacaatcggaagcaccaatgaaattgccaacagccacagccctgcataactatctgtaaatacataaaacatcacgcataaaatcagttcgagtccccatagaatccttgattttgccatagtctctcctatcgaccattatccggcgattttgtctgttttaaaacttctattaaaacatccgaagccgaaagtgctgcaatttttgcctttggatttaaaataatacgatgcgcacagacgtccaaaaagactttctgcacatcttccggggtgacataatctcttccctgtacgtaagctcttgccttggcaagtctggtcaccgcaagtgcccctcgaggactgactcctaaacgaatcatctcctgttctctggtattcattgccagagaggtaacatattctaaaattttatcttcaatgtaaatctgtgtgacttcatcctgcatttctaagatttcatcggttgatgtcacctgctctgccttatcgagtggattctctgtctgacggtcacgcaggatattgacctgactttgaaaatccggatatcccatttccatacgaatcataaaacggtccaattgtgcctgtggcagcaactgagttcctgcagaaccaaccggattctgggttgcaagtaccacaaacggttttggcaattcatgcgtctctccatctactgtcacctgtccttcctccataacttccagaagcgcagactgcgtcttactggaagtacggttaatttcatccgcaagcaaaagatttgtcataaccacacctggcttatattcaaatgttccactttctttattatacattgaaaagccaatgatgtcggacggcacaacatctggtgtaaactgaattcgatgataatccagacctaatactttagagcatgcaagtgccagcgtggtctttcccaccccaggtacgtcatctaacaaaatatgaccccttgataaaattgccatcaatgtcttttccagcaccgcttcttttcccacgatgattttatttaattctttcagaatttcttctgtttttgtattcatctattcctgcctctcttttcctgattctttatttttctgtttcttttaccattctttgccataattaccctgaacatttccgtatacaccttcatttccatactgaccgatatcctttcctcctgccagggtgtaacggacacgaatttcatctccgtcagaaagatttctgcttgccattcctgttccgacgtaataattattgacgcagaccatccagcctgaccattgtgcaaaatctttttcccataaggcatcggtctgatagcttccggtccagcccattccatcctcaataatcatctgtttcaattcatccggtacacgaagaccatttgtcattcccggctttttgattccggcaagataataactgttgtccacacttcctgtaatcatagaagtaaaactatattcagcaagctgttgttcgactagctgtgccagcgtggtgtttccatctattgttacttcatgacgtggaatcaacattccaagaccgactgttccggcttctaactggaaggtaacggtaatctgggacggattataaagtaccgtataggtcttcgtcgtctcatactgctgattatcttttacagaaatgacaacttcattttctccctgctgaagatgcaggagatattcataagcagttccggaacaaccacgatattttacttcttctccattgacgtaaatgtgcatgttgtctgcacttaatgcgccaccgccaccactgacttcttttgcagaaacattcaaatccacatattcggtgttgtattctgattttaaattatgttccacaaccggtgccatattggatggtgtctcaccggttcggttaaattcgatattccaggtataactgcccgaatttccattggaatcaataaatccaactgcaattggcatctccctgtctgcatacagagaaattgtataccagccatttgaattggcagacggcgagtatgttccacctctgctgtctccgcagaccacacttgtaatttcttcttttccggtaatctgactgtgattgaaacggaaacgaaaactatttgtattattttcatatcgaaacgtctgagaacctccgctcatctgcggggtaatcgtactcgaatttttttcaccctcaagcgtcaaagtaaaatcgtccgcctgtttttgagaatcatagtaaattgtataattctctgataccgttgctgttccggttcccgcaattaatgtaaatacattctttccttcacttaaagtttctgtataagcggtatctccatcggtcgattttagggctttttcactatttcttcggatgattaattttacccgctctgttccttttaaggcataagcggtaaaatcaagctgttgttcctgcaccgtctgtccatctaatgcttttaactcatcggcaataatcaaaatctgattggatggattgtaataaatcgtataggttggagaagagactcggatattgctccatttatcacgaaatgtcacataaactgtaactttattttcaccttcagaaagagtaatgcttccgttataattctgctgattcccatttatgtcaactaccgtactaatcacagaaagtttggaatgatacgtaattgaaaatggatattctgcttccgttacaacttcgtttttcaaacttgtcgtaaaatacgcttcagaattttccggtgctaccacaatctgttttccatctttctggctgtccccgtcgccgtctccttttccgttgccattgccaccggttccctgaccactatttccggaatttccatttcctccattttgactgtcaccgccggatggtcctgtaccggaattattttttgttttatctttttttacaattggaagcaagctgtcaagttgttccgaattactgtcaagaggagtctgtgaaacctgctgctgttcctcagaagtttgctgttcctgtgtttctgtagaattatccgaattctcttcttgattttcttcctgctgttgttcttcttgctgctcctcgtcctgattttcttcgtcttgttcttcttgttgctcctcttcctgttcttcttgattctcttgatttcccgtattgatattggcattctccacactgtccagaagtgactcatccatggccagactggaggaggtcacatacatacgggatgggtctgcattttctttttccataggattttccggtgctgcctgattctgtgtcacagatacgacaaaaagcagcagaaccaaaatcactgctgctacggtcataaatgatttttttatttttttccagaaattccgtaaattcatatcttctacctactctttttatatagagaagaacagacccctgtcgccagggtctgctcttcctttgttttattactgtttattactgtactgtttttttgtaacacattgattttctatcaaatgttagcctgtccgtacactaattatctgcttcttgtgcgtacaccggatgcatttacatagtagtttccaatccatgtattggttttcatagcaccatcattggctccgccaaagtagtaccagtttccgccaatcttctgccatccggttttcataacaccatcatttgctccaccgaagtaatatttctttccgtagatggtctgccagccggtcttcattgctccatcattggaatgacccagccagtaatattttccataaactttctgccagccggttctcattgctccgtcgcttccaagccagtaatacttgttgtaaactttctgccagtgtgttttcataacgccgtccgttccaaaccagtagtatttaccatctactgactgccagtaagtcttcattgcgccatcgtttccaagataatatttcttgccatcgatcgtctgccagcctgtcttcattgctccgtcgcttgcatttccaagatagtatttcttgccatcaacggtctgccagcctgtcttcatcgctccatcattggcatttccaagatagtatttcttgccgtaaacagtctgccaaccggttctcattgctccgtcgcttccaagccagtaatacttgttataaactttctgccagtatgtcttcatgattccgtcagttccaaaccagtagtaatttccatctactttataccagtaagttgcctgtgtaccatcttctttgtagtaatatttcttaccgtcgatggtctgccagcctgttttaacaaccagtccatctattgctgactgaagtttttcagtcatttcggcaacctgttctttggattctggattttctgctaccgcttctgcttctgcaatcacatcctgtaatgcattgtaagattcatctgtgtatttggaagcatctgttgcttttgccgtttcaattaaatcctgaagtttgtctgtatcaattgcggaatttccaactgcaatcatgtacgcagagtcattcttgaagtaaatggtgccatctttgtctaccgctacgctggagatgcagtattgtttgtgttccggtgtatacagaacctgacttccttcatctggttctgtcatgccaggagcatcttttacaacccagaggtttccgcttggtccgtttgttgcaaagtatacatagttatatcctttgtaacctgttgatacaacacctgaagtctgaggataagcatctgtgtatactacatattcaagattcattgcacctgtttctgcattaatatctacaactgagattccataagttccactgaaatttgaaccgtaagaagaacctacataacagcgaccatttgcgattgccggagtacttgtgctcatttttccgatttcgattggctcaatcagattttctgtatcaattgttccgtcttctttcaggttataggaatacagatatccaccttttgatgtaaaataaattcttccgtcataataggagatatctgaacggatatcgccatgatgcggaccgactttctgaactacttcaccagtcagcttatcaaagcaatatacataagaagaatcacttgttgaatcggattctccatcatcgcttcctacgattgcgtatttatcagttacataagcacctgcccaatagaatccaccctgtacggcataagtccaggttgcatattttgtttctgtcggattatctgggtcttcatctgttgcagaaacacatacgaagtttgcatcttttgtttcactgttccagaatcctgtataaatatatccatcagaatactgaatcgtacagtttggctgtcctccaagtgtatctttaaatacccataaggattccagagtttctgcattaaatgcctgtactgctccacctgcaagtcctacaaaaatcattccaccaccgtagcatggagggttgattccaaaactactgtttcctgccatcggtgcacttgcaatgatatcaccagtttctttattaattttaagaagctgttttcctgcatagcagtaaagattgttgtctacgataatcggagagctgactgcccagttgctgaacccttctccgactttcttttcccatttctggaatgctgtttccggtgtggctgctgtctttgcacttgttacagcctgattacttccatcttttctaaatccagcccagtcacagtctaaatcttttaagttgctgctctgcgctttttccagagaagctttgataacagtgtctttctctactgtaatctcttcatgttttgttacataaccggtcttagataccgtataggtataagttcccggaagaactttataaatgccgtcttctccgcctgctttgattttatctttgtcaataactgtgataattgcatctttcggttctgtttcaaaagtaatcgtaacaggttcttctcttaagatagaaactgtatatttgcccgcaacagtattttcatttcctacctcaatttctgtaactacttttgcatcgtctccggttaaggcaagtgtgtattcaccgttttctgctgtctttccgtttactttaatttcagaattggcagcggttcttgcagttgctttaaatactacgctttctaatgtcttaggaacaacaatcgtatattctttttttcttgcattgaaaaccggatctaatgtcacttttgttccatctgcttttgtgacacttaaaccggaaagggtcgtctcacgaataatatgaactttataagtttctgttttaccggtttttgaagctacatcaattgacatttctcttgcttcaatgtcagactgaagcacacgatttacaccgctaaactgtgtaaattcatttgccggcatagcttttgttaaatcttttgtatagttatagtttttgtagtttgcagtaattgtattaacttctgcatcatcacttaaaaccggttttaaataaaatgtatttaccgtttccggtactgcaacggtacattcttttgtctttgcatctaattcagactgcatcgcataaacattttcaccgtttttatcggatgcaaatacaaactcttttaccataggctgtgcagcacttactgttacttcacaacttgctttgaatgttcctgctgttacagtaattgtagcacttcctgctccaactgcttttacagttgcgctcttgccttcacctgttacggttgctacatttttatcatcagattcccatttaacatctaaatcttctgttgcatttgcaggttcaaatgttacatttaatttgctttctgcatcttcctttaaactcaggctttctttgtccagagcaatttttgtcactgcaatctgttctactgttactttgcactctgcactgactactgtacctttattattggtaaaggaagccttgattacagtagtacctggagtttttgctgtaatttcgccattctgtgcgtttatatcagcaactcctttatcagaagattcccatgttaaagccggtgccgtttcacctttttccagttccggtgtataagccggtgtcagagtttttaccgcacccggagccatggaaatttcagttccctccgcaaaggaaagatctgttacggttgtaccgtttgaagtaacttttacatcgcaggctgcttcaacggtgtctcctaaggtattaaccatagaagctttaacggtagttgttcctgctgattttggagttacgactgcacctgtttcagatgctgtaaccgttgcaacatcctgattactggaagtccagtttaatgcctttgatacggttgtctgagccggtgctgtaaaacttgtcagtaaatcgatatccgaaccaacttctgtttcgatttctgttaatgcagcatctggctgttcctctgttgaaaaacgaagtcctgttacagcatccgtatcatagttaagctgggtattccaggaatcatctgtggtcagacgacagtcatttgtcggattgtctgaccagtaataaatcagacggcatccatcctgaagctgggcagctccatcataactactccatccattggaattaaaagagccatctgcgtactgaacgataacagaccagtatcctttactccagtcactctgtaagtcaactccgtccttatttttcatatcatctgggaagcagctgccttcatctgaaaaatgatagtcaatctttgcttcttttaatgcagccttaatctggtctttacagttttcagccacataataactttccagactgtttacatcaatattaagcggctggtcttttaaccaatacacatatccggtatgttcatccagatttttactgtgatttccggtatcgccgattacagttaaggtaatgcctgtatttgtatctgcttttgcaacaaccggataccaacccgttgcaacagttgatacaatcattaacatcgccatcagcattgccagaaatcgattgttctttctctgtttcattttgtttcctccttctttttatgcgctttgagagtgcattatttcttttgcgttatataaaaaaagaccttcccatcaggaaaggtcttcatttatccttgtgtctactgtgttataatgaaatagttcataactatccgcagtatttttcactctatgtattctactgcaaattcaaactttttacagtatgcttctactttgctgtcttttctgcaccgtatcaccgtacttttgtttacaatccagtctccgataaattccggttcatgagcaatctcaactactttcagacgatgacatccatgaaatgcccattttcctatccgcttcacactttctggaattttcacggattccagattgttacattttaaaaatgcactgtctccaatctcacgcagtccatccggaagttccagttcttttaatgctgtttgataaaatgcctgagaaccaatcttccgaagtgccaatggaaattctaccttttcaagatttaaacatttataaaaggcacgacttttaatttcctggacagactttggaatcttaatttccttcagactttcacatccataaaatacctcttccgcaagatacacacacgttacactttcaggaaaagttgctgtttccagtttcttacaccgaaaaaaagcaccttttccaatgtactgcagttttttggaaaattctgctttccgaactctgatgcaacacgaaaatgcttcctgcttaattctttctatgttatcaaaacacagttcatttaaagctgtacaatttgcaaagctctgttttccgacttctgttaccgatgaaggaatctgtactcttttaatttttacgttattcatcagtgcttcatcttctatctttctgcaatccgaagccagtaccagttctttttcccgtactttctttccctgtgctctggtaaaaacatttttttcttttgctttccacgttaatatttgtcccattgtcttatccattcttttccttttcatcaagctaaattggtaaagaaaaagaaatctcccagatcacgggaaatttctttctttacttttcgcatgccagagttgctgtcacatatttaaaatgtttattcacatacacaaaaataaatttactttcttttcccgaaaataaatttaaattcacaaaacggcagttttctggcttcacaacatctgtgttacagtaggggaaactgcgccggtttctcaccgagcttaccttttaacctatcttaaatcattttttctgttttcattatttcgtcaaggaccgttttaaaacttatttattttctgtaattatactttatttttccatttttgtaaagcaagtttgaaactttcttttagcaatatcagactttttatatgcaacaaatcctgtcgtcgtgattatcatctcggtcaccggaaagttaaatcatcggagcaattccatcaataaactttttcacatagaaaagagccgcaccgattgccggagtgtactgtccatttgtcccaactattagattttcttttggaaactcaaacggaagcgatgaattgatctgttttaatagataattcaaatcattctccataaaatagggtgccagatacccactgataataatcggtccgtcaatgaccagattcagatttctcatggcaaatgccagatgttttaaatactctttccagatttgctttatattctcctctttattttctcttagtttttcaaaaaattcctttattgacattcctgcaatttcagacagtgaatttgcggaacaataggtttccaggcagccacggtttccacaataacacagcggtccatctgaattaatgcaaatgtgttcaatcactccgctatgcatgaaacttccttcatgcacctttcgatttgtaataatcgctccaccaaggttgcgatttaataaaaacaccactgcactgtcgagttccgaatgattccataattccagataagcagccgcttttgaatcatgtaccagacggcatggataaggcagcttagaagaaaaatcagacagacgcatcttcacattattcataatcgtaccatacatgactctggaaccatccggagaaataattccctgagttgcaatcgaaacaccaaggattctttctttctgatatttgtattcttctataaattcatctattttatttgctaccttttcataatattcttctgtatcgctataatccaaatcaatggtgtcttttgcaatcacctttccatataaatcaattgcaacaatataaaacattttttttaaaattccaattcctattgaaatccggacatctgatacaatctgaatcacctgtgcctttcttccacccgttgattcgaaatagccatctctttgaatcagaccttcttcttcaagcacatttaaattttgactgacagtagacagacccatctttaaatcctgcacaatctgaagttttgaagtctgtttcgtacgataaatatattgatataccttttctttattaatctgttttaatgtaatcgtagtaacgcctcgttcgctcattttgtcctccttgcttttccatacttttcagtcatagttccattttaatacagtatactatgaaacgcaaacaagaatattttatgtgcattttaaccaaaatgagttttaaaaaattgttttttatgtcaatagacatatttttcctcttattatatacttaacttacagttaagtaataagcgtaagtaaaaagaaaagtattaaaaaaaaaaaaagaaggaggacggcaggtcgctggttttaagagccatgttattgacaccaatggtgccggagattccttctggggtggattcttatatcaaatcaatcaggtcggaaaacgaccggaagaactttccttgaacgagttggacaactttgcacgattcggcaatgctgtagcaagtttatgcgttgagaagaaaggggcaatccccgcaatgcctgatttaagcgaagtcgaaaaacgagtcaagcggatattcgacaaataaacaaaactattcaatataagaaagaaggaataaaacatggatttaacaacttactctaccggaatccagcacattggaattcctacaaacgacattgaaacaacaattgctttttatcacaaacttggatttgaaactgcatttgaaactgtaaacgaagaagccaatgaacgtgttgctttcttaaaattaggaactcttgtcatagaaacttatgaaaataaatcagctaaattagaatccggtgcgattgaccacgtagctatcgatgtcaaaaatatcgaagaaatttatgactatattaacgaaaacggactgaatacaacttccgatacgattcattttcttccattctgggaaaatggagtacgcttcttcacaatcgaaggaccaaataaagaaaaagtagaattcagccagtttttgtaaaactcctactggtaaaaaaataatttaagaatgagggtgtcccaaaactatgatttataaagtcagacatagagaggggcatccttcttctctttctttaaaataacgatttccattaaaaatggcactggtttcttatccttccagtgccatttttgcgatattatgggcaattgccaacagtccccattcaattttaactttgtctgctccacgtaaatgaaatcgtcggaatgaccaacaacctttgatcctgccgaagacctgttccacttccacaactctttgtgaacgaagcttatgtcctcttttggagcaaaggtttgcatttgctttcctttttagttcatttagccggtgggataccatgattgtacgatttttatctgtgttcttgcattccgttgcatatggacaaccagtacaatcctcgcatcggtaataatcccttctggtttcatacccggcttccgtcacatatttccggtttccaatatgtaacaactgctttccgttgcggcagacaaagcgatctgtttccgctatatagggtaagttatctgtcagatacggattctctctgtttttctttttcttttcccaatgaaacttgttatatttcacatagctgcccagattcttttcttccagatattcataattctcttcgctgccatagcctgcatctgcaacgatgttttccggtaatcgccctaatcttttttctaaatgttttaagtgggggatcatggttttggtgtccgttggatttggatggatggtaaagcctacaatatatctgttttcagtgccgatttgtacgttatagcccggttttagctgcccgttaagcatggcgtcctctttcatacgcatgaaggtggcatcatggtctgttttggaataactgttgcgtccttcaaatatagcaaaggcctcttcatatttttgttttcttggaaggatatcttttttgaattccttcgcttttttctttaattttttatccataggatttttggcaagctttttatctatgcttttcacaacaccttccacctgccctgtcgtaatgcggctgtttacgcccgtttcttccaaatcatcctctaaataaatctcattttcctctgccacaatgcggtctatttcacgaaggtggttctttatcttttcatccagtttgcggtcatagttgcctaccgctttattccatacaaaagtatacttattggcattggcttctattttcgtaccatccaaaaagtaattctgcaactttatgtattttttttcaatcaaaagtttgacgacttcatagaacacatcttctataacatccttcatatccaggcgaaagcggtttatcgtccgaaagtctggtttgtttccgcctgcgatccacataaagttgatgttttcccgaagagatttcgctatctggcgagaagagtatgttttctgggagaatgaatagatcataactttcagcatcatcttagggtgatacgccgggcatccgccttctttgtatctgtcgtagagtggttttaaatccaaacattccacaactgtatttacgacccgcacaagatgattttcaggaatgaaatcttcaaaagacagtggtaattgtaattgagccatagtataatctttaaatgtaggcataccttattatatcacataataaggtggaaatggagaacggcgtggtaaccgttctctatttttttacacttttttacggaaagcaagagggcaacccctcaagtcatttcatgacttttgggacaccctcttctcccgttgaccggagattctgaaatacgcgggccggaatgattccttcccggaagtccccgccggtctccagagcatcggccctggcggaaaccggccacagggaaaagccagggcagccgccagcagcatgctgcatactttatatttcatagcttatctctccattctgccggtcctctgttttctgccatatctacaacctcctgctgtaaaagccttttagcccccgcccggacagaatccgggcagaggcttctgactgtttttctgtttttttatttttccgccgtgcttctttttctgctgaacactgcgaggacaatgcctgcgcccaccgccagaatcagcgccgaaacatacggcagcagatccgtttcatcaccggtctggacacttcctgttcccgccgcgcctccagctgtggaagaacctgtaccgctgccggatccgtttcctgtgtctccagtgcttactgtagacgcgtccacaactgtgccgaacttgcccagcgtgctcaccgtcactttcagaaccccttctgttactgtcccagtcagcgtttctactttgccatctgccacatgcagaaccttcaaagtctttccgttgtatttttcgcccacctggatattcagggtgatctctccctccggctgaacttcctgtccatccttatagagagccgcactgtacaggcgaatcagggcttccttcgaggtaatttccttctgcatcagctttacatcactgtcaaaagctgtcagggcttccagtctcagttcccagccgctcaggccctttccggtcacagatatcggataattctggtatgtcagtgtcacctcttcatctggagtcggggtcggcgttacatccggcccatccggattctcagcactctccagctcctgaatcctgttctcgcatttttccaggacagccatcgtttcttcagttacatactgcttctgcgcgtccgtcagcgcttcataggcctcgcgggccgcctccactgccgctttatccgcaagcgtcagcgtgtctgccgccggcaggctgttgatctgctctgtcacggcgtccgccgccgcctgatcggccgcctgctcttcaagtattgccatctgttccacggccttctgtaacttttctacaatgtctgcagaaatcaaggatttctgttcatccgtcagcgcttcataatgcgcattcgcagtttttacagccggagcatcttccaatgtaagctcttctgcagatggaagagatacaatttcctgctccacctctgcagctgcctctgcatcatccgtcagctcagcaatctttgcttccagatttgcaagcttctgtacagtctcttcagttaccagcgctttctggtttcccgtcagcgcttcataggcctcgcgcgccgcctccactgctgctttatcctcaagtgtcagcgcgtctgccgccggcaggctgttgatctgctctgttacggcgtccgccgccgcctgatcggccgcctgctcttcaagggctttcagctccgcctccgccgctgtcagaacgctgtaattcgtcacatagctctgctgctcctctgtcagcgcgtcatatgcgttccgggctgcttcaatagcctcccggctatccagagtcacggttccgatctcttcaatcagatcgataactgcctgcgcttcctccggtatctgcggttcttccggattggagggatttgcaattgcatccctcagggcctgctccgccgcatccacagccgtctgttcgcaggtaatgtcgctgatggccgctaccgcgccttcgtaggctttctgcacatttgcgtactccagcagctcttctttatcctctctgccgttaaattccgccagcagcttcgtaatactgtcgccgttcacattcggtacaaacggatcgtccacgtaaccgtttccggaacagagatcccctttcatcgccgtaaaacggatccggatcacatctccgtctttcggctccgtatcactcatgcccacattcggcatatcattgttcagcgtatacatccagccggactgatgattggtataatcaaattcacccagcgtggctcttcttctgggatttgtaattttaatgccctgttcttccgcgtgcttcagggaaatctccggaaactctgccgtcaggcttcctgcctcatccagaatccaggaaagatagaagctgctgtctacgcttcctgtattgtcatagcgaaggccgttttcacccaaaaccctgtcaaggatctgcgccgtggattcgccttctgtgatttccaccaggacaggctcaacgagataaccctggccgatggtgaatttttctatggcgactgtcacgtacgcctgttccggctcttccgcatcttccagctcctgaattctgttttcaagctcttccagagctgtcaccgtctcttctgtcacatactgtttctgtgcatccgtcagcgcttcataggcctcgcgcgccgcctccactgctgctttatcctcaagtgtcagcgcgtctgccgccggcaggctgttgatctgctctgttacggcgtccgccgccgcctgatcggccgcctgctcttcaagggctttcagctccgcctccgccgctgtcagaacgctgtaattcgtcacatagctctgctgctcctctgtcagcgcgtcatatgcgttccgggctgcttcaatagcctcccggttctccagggtcacggttccgatctgatcaatcagatctataactgcctgcgcttcctccggctcttcaccgcccataacgtcggtcatatcatagatatcgttttctcctgccgcgaatctctcccaggccgctacggccagaagggtctgctgcgtagccatttcatttacggcgccgcccttcgtatgggcgaaaccgccgctttcgattctgtactcatctgtcgcggtgaaaatattcgcgccccaggacgtaaatccactgtcatcatccgagggggcgatgcccagcatcagcagcgtcaggattacctggtcgttggattctaccgtaccgtagtcgcccatgttaatattgcgcttcaggtagtccagcgctttatcgacagccgcctgcacatcctcccggtctgtatatctggacagggcctgcaaggacatggccgtcatatctatggagcctgttccggataccggtttggaaagcacaaagcttccgtcatctgcctggaaggataaaagctcctccatcagcgtatcccggttccatcggcttccctctggaatatttactgcatttgcatctaccgccagcaatgcgtaagccgcctcattggtgccttcgctgatcctctcgctgtccagtatccactggatcaggtctaccgtacttccgtcctccatctcaatgtttctggggtcgagtcccagggcatacatagccagagctgttctttccagatccgtgggctttccgtcagccgtcagatcaccgtactcgtctgccagctcctcctttacagaagcaagataagcctctttatccactcccatgtcgataccggcacgctccagagcgatgatgttccactccatcccgtatgtccaggacggttcggaaccttcataatatttctgaatagacgccttccaggtgcttacaagctctgtggtatccggaagcaccggtttctctccaccgcttcccacatgaatggtaaatgtcacggacgggcttgtaccctcggcagccgcagccggggttcctgtaatggtaacggttccttcctttacgcccgtcacataatagttggtattggagaaccagtcgtactcgctgttcaccccgcgggtcacttctacttctccgtcgccctcctgggtccaggtgatcagggcctgggacggctgctgcggggtataaacgatgggcagggatgcctgctcccctacctggatcgtcagctcgtcttccccggcttccagtttttcaatgggatgctcccagtaaaaagtcacatcgtcacttgcggaaacgggattctctccatcctgcacggatgcggtaaccgttatcgttcccgcattatggccgatgattccattctcaaaagtattccaccactctcctattgtttcatcgctgctgctccactgtacgtcatggatatagcttgcatttgccggagtgacggtcagggccgcattcagtatattctgctgaagtccctgatagttatcgccatttccaagggcataattcagccggtgcagcgggaaggttttcggaagctccagcttcatgctttctatcgggacatatgtagattccatatggatcgtgtgcgttttcccctcgccgtatgttattatcagatcgccttctccgggctcggtaaattcaacatacgtaccgctgtcgtagacagaaatctccatccggtcattgccctggatctcataatccgctctggaaaggctgacaaatttttctgtcccctggtattttccggaaattgcaagttctacggacgcgctgccttccagtgtccatttgcctccgtcagctacagtctcatcattgatattcacccggagctcctctatctcataggcgacggcctgcagcttaaaacggaacaggataaaatcataggtaccggtcagatagggagacttggagccctttaacgcgacctctacggtatccggcgacgtcacagttatatctccggtataggtacctacgcccacgcctttattccagctttcctcgtccagcacatcccatatcgtcatttttccggctcccggcgtatagccctccatcacgacctttccgcttccggaagttgggatggtgaatgtggagccattctctatttccgtcttttcaccggtatcactgttttcataataaactttcaggtccgcaacttctacggtataactgtaaatagcctctccttctgcgttattcagagaaaccttcgtttcacccgcacccacggctgtcagggtgccagccgactgtacctctgccacctccggattggaagaaacccattcactggcgtctgccacgttctggtagctgaattttccggtatctcccacaggaatggcaaagcggtacccgttatccagcgtaatgcttctgttttccgagtcctgatggtaggttacagacggatccttcgcaatatccgggtcttcccgggtcagcgcaaagctgaaatacaccttatcgacctgatagctgctgttgtaatgtacgacgtctacttttgaggaaaccgccgcatccgtaaagtacaggctgtttcccacccggtagaaattactgtctccaaagcgcataccggtcatactggactcttccgccggcacgccctcataatacagctgtacctgtccgcttgcatattccggggcgatattgacggtatcacccgcctggacttcctgcggatcgccgtcgggcagtacataatatactttcacggaagactggggttcctcgtccagggctgcgtaagcctcctccgccgcggtcagcgtttcataatttgaaaccagcgccttctgcccgtctgtcagggcgtcgtacgctttccgggccgcatcgatggcgtccccgctctccgctgtcacctctccgatggcatcgatcagcgcttccactgccgctgccgccgcttcatcatctgaaattgccgcaccctgccaggacagcaccggataaccgagaccgccggcatctcctgctttataggcgtctcctccgttattcagagcgcttaaaaattcatccatatccttcgggatctgtgacgcgtacgcatcgtctccggacgcgcagtagttattgcttcccggcgcggcatcggaatatcccaccgctttagccgcagtggtatagcagttgctgaccgtcgtttccgcgcttccgtttcttccgataattcctcccgcgtaagcaaagctggttcctcctgtcaatgttcccagagaataacagttttcgattacgcaggctgcccgggcttcacctacgattccgcccacatgctccatggaatccgccgttaccgccacattcgtataacagccggtgatggtcgttgagccgtttgcccgccccaccagtgcgccggccgggctgtagccgggatgatttaccgtaccttccagtcccaggttctgtatcacggcgcctttctccgtggaaaagaagaaaccggccccggaaatttgcagtccgctgattacatggccgttcccgtccagggttccggcgaagccgctgactggtgtccacggcgccgtcagttcgatatcagacataagacggtaatttccgtcagccgctatttcccgcagcccgttctcgtcataaatctctaccacgccgcccagcagggctttatatgcctcttcggccgcctccagaacatcgtaattggaaacctgtccctgctcctctgatgtcagactgtcataggcctcccgggctgcgttaatggcatcgtcgctttccttagttacctctccgatggcattgatgagctctataacatgctgtacagcctctgtctgatctggctcttccggctgttctccctgatcatgctcgttcaaaaggcgtacggtataggttgcgcccttatactcaatcttgaactctgcagatccctgctgactgagcgcgctgtccagagcggctttcaaatcagcggaaataccaaaggttccatagttcgttgtgctgtaatcataatcactgttttcccggatgccgttaaaatccagatacaggttatatgcatccagtccattcacgtccttcagagctatgccgtattccgtatagctctgaagagggctgttatttttcgttgtccgatccagaagcggtacttcaatcaacccgctttcgtccggataccatgccttgtcggtctccagcccgctattcagatcatactcctgcagccagaacgacgcgctctcatcattccctgtccgctccgcatctcctccggcagcatataccggcaggcttcccagaagcatgacaaaggtaacaactaccgccagaatacgtttcatttttttcttcatgttcttcctccttcttgttatttcattttctcctgcttctgtccggctaccctcctctaaaacatttcatgcattttctcccttcgcctgttttttcctgctatatctgcttctaaataaactggctatatatcgtttatttcaaacaaataaaaagcaccatccttattatatcacataataaggtggaaatagagaacggttaccacgccgttctctatttttttacacttttttacggaaagcaagagggcaacccctcaagtcatttcatgacttttgggacaccctcattctttttttctatccataactttttgatataaatagaatcaaaataaatgatttaacgaatttttgaacttatgttatgattacaccatcaaataattaacaattagaaatctattttactaggaggaaacacatgtcagagaatacttgtcttgaaaaacagccattatctcaggaaatgttagataaaatggatgcttattggcgtgcatctaattatttatctgctggtcagctttatctcttagacaacccgcttcttaaaaagccattgtctatggaccagattaagaaaaaaattgttggtcactggggaactgtaccaggtcagaactttatttacgttcattgtaatcgtgtaatcaaacgttacgatttggatatgattttactttccggtccgggacacggcggaaacttcatgattgcaaacacttatctggaaggctcttacagtgaaatttatccgaacatcagccaggatgaagaaggtatgaagaaaatgttcaaacagttctccttcccttgcggtgttccaagccactgtgctccggaaactccaggttctatcaacgaaggtggcgagcttggttattctatcgctcatgcatttggtgcagtatttgataacccagacttaatcgctactgtagttgtcggtgatggtgaagccgagacaggtcctctggctacctcctggcaatcaaataaattcttaaacccaattacagacggtgctgtccttccgattcttcatctgaacggatacaaaatcagcaaccctacaatcttctctcgtatttctcacaaagaaatcgaaagctattttgtaggatgcggttgggaaccaatcttcgttgaaggtgacgacccaatgacaatgcataaactcatggcagaagctatggatactgcaatcgaaaaaatcaaagcaattcaggaacatgctcgtaaagaaaacgatgcggaacgtccagtatggccaatgattattcttcgtactccaaagggatggacaggtcctaaggttgttgacggacttcagattgaaggttctttccgtgctcatcaggttccgattacaatggaaaaaccggaagaacatctcccactgttacaggaatggttagaaagctatcatccggaagaattattcgacgaaaatggtcgtctgattccggaactggctgaacttgctcctaagggaaatgctcgtcttggttctaacccacatgcaaatggtggtcttttactgaaagacttaagacttccggatttccgtacttatggaatcgatgttgaccctggaaaaacaaaagctcaggatatgattgaacttggcggatacatccgtgatatcttcaacttaaatcaggataacaaaaacttccgtatcttcggaccggatgaaagtatgtccaaccgtctctacaaagtatttgaagctgaaaagagagactggaacgcagaaatgcttgatacagatgactgcctggcaagaggcggacgtattatggatagtatgttaagtgaacatatgtgtgaaggatggttagaaggttacctgttaacaggtcgtcatggcttcttcgctagttacgaagcatttatccgtgttgtagactccatggctgcacagcatgcaaaatggttaaaagtctgcaatcagctttcctggagacagccaattgcttccttgaatttcattcttacatcaaatgtatggcagcaggaccacaacggatttacacatcaggatccaggattccttgaccatatcgctaacaaaaaagcagacgtagttcgtatgtatcttccaccggatactaactgcttattatcctgcttcgaccactgcatcaagagtaaaaactatgtaaatgctatcgtagcatccaaacatccaagttatcagtggttaagtatggaacaggctgttaaacactgcacacagggtgtaggtatctgggaatgggcaagtaatgactgtggtgaagaaccagatcttgttatggcttgctgcggtgatacaccaacacttgaaacaatggcagctgttactatcttgcgtgatgaacttccggaactgaagattcgtgtagtcaacgtagttgacttattcaaactggagtccaaccacaaacatcctcacggattaagcgacagcgaatacaatgcactgtttacaacagacaaaccggttatcttcgcattccacggttacccaactctgattcatgagttaacttaccgtcgtgacaaccagaacgtatctgttcatggttatcaggaagaaggtactatcacaactccattcgatatgagagttcagaatgaaatcgaccgtttcaaccttgtaaaagatgctatcatgcaccttccacagttaggaaaccgcggttcttacctgattcagaaaatgaacgacaaactggtagaacacaaacagtacatcgcagaatacggacaggatatcgaagaagttcgtaactgggaatggcatacaccagaaaataaataattaacgttttctatgatacaaatttctctataaagtaaaaaaccccggaactgttatctgacctccaacagctctggggtttctattattctctatcatatcagccagagtaccacgtctataatacttgcataggcgtgggtgaatggctgtgttttattttattccctgatttttaatataatttttcactacatccagagtattttcacttacggttgcaataaaataactgtcagaccaaaaataaggtttccagtaatactttttaagcagtgtatcgccataaagcttacgaactttgcgggacgtctgagtttttattacattgacaagttctgacggaggagtctgcgggttcgcttcaataagcagatgtatgtgatccagtttcccatttaactcaagtatattaaaccctctgctttcagctacataattaatccgttcatagacagcagtttttacatcgccggtaagaaccggatgtctgtattctgttacaagtactatatgatatcccgcagatcatggtgttaatttaaaactcccgggtagaaaggaacgcctttatctttcaaatgtagaagcggattccgtcctcaaagaggttaaaatcaagccttattatggaagatacatcctgtgtcttaccctcgaaagtgaaaattttgccgcagataatacagacatgcccaacctatgcgccatagactttggtgtgagcaacttcgcagctgtcgtatgcaatgattgttcatcaatgctgtacaagggcggagcggttctgtcagagtgccagtggtttcacaaaaagagagccaaagctgtcagcattatcacaaaaggccatgaacacatgcatgccagctccaggtacctgagcgccttaagcaggcatcatgccgatttcattaaggaccagtgccataaaatcagccgcagcattataaactactgcatggaacatcacgccggtacacttgttcttggcgaaaacaaacgctggaaacaggactgcgacatgggttcacagaacaaccagaactttgtctcaatgcctacagggttgcttaaaaggccataacggatgcatggaacagcataactgctttttcattcctcgcatcacctgaagtgtcaggattccacgaactgaatcccctaagtatttccgtaaaagggatagcggccgcgtgaacggcctcgacaggtggtggacagcttataaaacgcaataaaatggtgtgatatgccattttattgcgcaaattcttttttgtttgtagcgtttttataataataaaaaaagaaccctttcggattcttcttcatgtttcttataaacatgtaccttcaaaactacatatacaaaaccgaaaccatgcagacacttgccgctccactgatttctcagcttctggtcaagccctcgaccgattagtagcagtcagctccatacattgctgcacttccacctctgccctatctacctcgtcgtcttcaaggggtcttacttcctaagaatgggatatctcatcttgaggggggcttcacgcttagatgccttcagcgtttatcccttccaggcttggctactctgccatgcagttggcactacaacagatacaccagcggcctgtccatcccggtcctctcgtactaaggacagctcctctcaaatatcctacgcccacgccggatagggaccgaactgtctcacgacgttctgaacccagctcgcgtaccgctttaatgggcgaacagcccaacccttgggacctactacagccccaggatgcgatgagccgacatcgaggtgccaaaccactccgtcgatgtgaactcttgggagtgataagcctgttatccccagggtagcttttatccgttgagcgatggcattcccacttaataccaccggatcactaagccctactttcgtacctgctccacccgtcggtgtcgcagtcaagctcccttctgcctttgcactcttcgaatggtttccgtccattctgagggaacctttgggcgcctccgataccctttcggaggcgaccgccccagtcaaactccccgcctggcattgtcccaccgccgggtcacggcggctggttagaaacccaatactgcaagggtggtatcccaacatcgactccgtagcaactggcgtcactacctctttgtctcccacctatcctgtacatgcaataccgaatcccagtaccaaactggagtaaagctccatggggtctttccgtcctggcgcaggtaaccagcatcttcactggtacttcaatttcaccggatgcattgccgagacagcgctcaaatcattacgcctttcgtgcgggtcggaacttacccgacaaggaatttcgctaccttaggaccgttatagttacggccgccgtttactggggcttaaattcaatgcttcgtttcctgacatctcctcttaaccttccagcaccgggcaggcgtcagcccatatacctcacctttcggtttcgcatagacctgtgtttttgctaaacagttgcttgagcctattctctgcggcccgcttttacacgggcaccccttctcccgaagttacggggtcattttgccgagttccttggcaatgcttcttccgtcggccttaggattctctcctcatccacctgtgtcggtttacggtacgggtacgttacaaacaatagcggcttttcttgacgcatggctcacacacttccctactctagttcggtccgcatcacgcctttggattgtcacacggtttttcctatgtgactcctccttcgcttgccccgggattccattcccgggttgtgctttccacacgtgtccccacagttctgttctaacgcagtacaggaatctcaacctgttgtccatcggctacgtctttcgacctcgccttaggtcccgacttacccagggcagatcagctttaccctggaaaccttagatattcggccataaggattctcaccttattctcgctactcattccggcattctctcttcaatacagtccacagctcctttcggtactgcttcttcccgtattcaatgctcctctaccaatgtattactacattcctcagcttcggtgtcgtgttttagccccggacattttcggcgcaggacctctcgaccagtgagctattacgcactctttgaatgtatggctgcttctgagccaacatcctggttgtcttcgaaatcccacatccttttccacttaacacgtactttgggaccttagctggaggtctgggctctttcccttttgactatccaacttatctcgtatagtctgactcccgataatcaattccatggcattcggagtttgatattcttcggtaggctttgacgccccctaggaaattcagtgctctacctccatgtatctctatcgaggctagccctaaagctatttcgaggagaaccagctatctccgggttcgattggaatttctcccctatccacacctcatccccacccttttcaacggatgtgggttcggtcctccactgcctcttacggcagcttcaacctggacatggatagatcacccggtttcgggtctgcacatactgactctggccctattcagacttggtttccctacggctccacgccttaggcgcttaaccttgccagcatgcacaactcgccggaccgttctacaaaaagtacgcggttccgcatataaagcggttccacagcttgtaaacacagggtttcaggttctctttcactcccctcccggggtccttttcacctttccttcacagtactatgctctatcggtcactaaggagtatttagccttacggggtggtccccgctccttcccacaaggtttctcgtgtctcgtggtactctggatcctgtcttgtcctctttcctttcccatacggggctttcaccctctctggctggctttcccaaaaccattctggtagaattaaggaatcaattatacagtccgaaccccagcatgcacgcacactggtttgggctctttcccgttcgctcgccgctacttaggaaatcgagttttctttcttctcctcggggtacttagatgtttcagttcccccggttcccctccatacgttatggattggcgtatggatacatgaggtcttctcatgtgggtttccccattcagacatctccggctcattggatatttgctcctccccgaagcttttcgcagcttatcacgtctttcatcggctcttagtgccaaggcatccaccctgcgctctttcttgcttggccattcagatcttatagcgttaacatctgacggctggtgttgcttggtttgtttctatttcttcgctgtatttctacagcgcctcgtttcgtctctatcttacgttttacgtattttagatgtttcgtatatgcagttttcaaggtacattcagatgtaagtttttgtaatgccatgaccggtagaactttgttctggaggttgcgagcatcacactcactcttattcatcttttggctgttttatcagccattcaaacacaaaagctttttatgcttgaatcactggtaaaatcaccatttgcttattttattttttgtaatccggcagccacctgctttcccatgccgtctccagcatagtatcatcggccgcttaagtcttaaccatcgtgttcgggatgggaacgggtgtctcccctaagcgcatcgccaccggaaatgtttggttattaaattttagaagttttccttccttaataactcaacagtgaaacacttcttaactacttcttcttccttagaaaggaggtgatccagccgcaccttccgatacggctaccttgttacgacttcaccccagttatcaatcccgccttcggcagctccctccctaaggttgggtcactgacttcgggcgttactgactcccatggtgtgacgggcggtgtgtacaagacccgggaacgtattcaccgcgacattctgattcgcgattactagcgattccagcttcgtgcagtcgagttgcagactgcagtccgaactgggacgttatttttgggatttgctccccctcgcgggctcgcttccctttgtttacgccattgtagcacgtgtgtagcccaaatcataaggggcatgatgatttgacgtcgtccccgccttcctccaggttatccctggcagtctcatcagagtgcccagctctacctgctggctactgacaataggggttgcgctcgttgcgggacttaacccaacatctcacgacacgagctgacgacaaccatgcaccacctgtcttctctgtcccgaaggaaaggttccattacgaaccggtcagatcgatgtcaagacttggtaaggttcttcgcgttgcttcgaattaaaccacatgctccaccgcttgtgcgggtccccgtcaattcctttgagtttcattcttgcgaacgtactccccaggtggaatacttattgcgtttgctgcggcaccgaagagctttgctccccaacacctagtattcatcgtttacggcgtggactaccagggtatctaatcctgtttgctccccacgctttcgagcctcaacgtcagttaccgtccagtaagccgccttcgccactggtgttcctcctaatatctacgcatttcaccgctacactaggaattccgcttacctctccggcactcaagaaaaacagtttccaatgcagtcctggggttaagccccagcctttcacatcagacttgctcttccgtctacgctccctttacacccagtaaatccggataacgcttgccccctacgtattaccgcggctgctggcacgtagttagccggggcttcttagtcaggtaccgtcattttcttccctgctgatagaagtttacataccgagatacttcttccttcacgcggcgtcgctgcatcagggtttcccccattgtgcaatattccccactgctgcctcccgtaggagtctgggccgtgtctcagtcccaatgtggccgttcaccctctcaggccggctactgatcgtcgccttggtgggccgttacccctccaactagctaatcagacgcgggtccatctcataccaccggagtttttcacactgtaccatgcggtactgtgcgcttatgcggtattagcagccgtttccaactgttatccccctgtatgaggcaggttacccacgcgttactcacccgtccgccgctcagtcccttacatcttcccccgaaggttctgtcgtaagcgcttcgctcgacttgcatgtgttaagcacgccgccagcgttcatcctgagccaggatcaaactctctgatatagtgtttgtccaagttcaagataactacttggctatctatcccttttactgttttggttcattgaaccgttctttttaaaataaatgaatgtaaaagaattttcgttttcatgtgtttcactgttcagttatcaaggttcctgtcgttctttttatcagcgacagcttctatattatatcaaagctgtttttgtttgtcaagaacttttttaacttttttcaaagtttttttgttttgactattcgtcgttgttgtcgtttccgcgacagctatattagaatagcacacctttttttaattgtcaacactttttctaactttttttaatattttttcattcatggaaaaatctacaattgatacatttattgagttctgttttctcctagtgtacagcgtccaagaacaaacttacgaaatacagtagatgcaatactttgaggatactctaaatcgtatactaatgatacacttctgtccggcatttcatctaatatttctatctgaaatacatttccgctcatcattgcctcttttacaaactccggtggcaaaaagccgattccaagattatgttcaattgccggaagcagtaaatctgttgttgcaaattccactgcgggttcaaacggtagtccgcgctttgcgaaataagaatccagaaaaatacgggtaatcgtatcagaggtcagactcacccagggataatgacacaattcacctaatgtcatcatacgcccctttagatttcgatattttctacccgcaattaaaatatctgtataagaatgaacggtatgttttataagagggtcttctatcgcaaatggaatagaggaaatcattgccatatcaacctggccttttttcaatacttctattgatttttgggaactattatttaaaatcttaaatcttacctttggatgaactttccgaaatgcctcaattgcctgaaacagacaacaatgaagtgctgtttcagttgcactgattgtaatagacccttcatctaccgacattaaatttgtaattttttgttctccacggaaaaactgtgcacatcctgctgagacatattcatagaaagttttcccctccggtgttaattccattccacttttgcttctaataaaaagacggcatcctaactccgcctccaatttatggatcgttcttgtcacagcaggctgactcgtctgaagtgctgatgcagcctttgtcagatttccatattttgcaacataataaaaaattctataatattcaaaatttgagttcatttttttatcccgctctcttacctctgtccgcttcactttctgctttgttttttcttcgtgcatcattttatgatgtgagtgtcaaaagtaaattttgccactcactgatgtaaccggattgctccattgctacgcaattcctgcaatcctcgaacacctcaaactcccataaaatggcggtattcacaccattttattacgttttcgttgttcggcgtgtcaattaagtatgaattgctttttgtgcaagcgcaagcgcaatttatacttttgacacttacatcattttatcacaaaaacaaaactttttgaaactattttctcttctaatctgtctaataagtgtaagataaaaaaaacatatctaaccgaaaggaggtttaaaaagttgactgatttaattaaaaaagcaatttacggcgataccgatgcttttcttgaattgatggacgtcaattcactggcaatgtataaagttgcaaaaggaatccttggaaatgatgacgacgttgcagacgctgtccaaaacactatcctgacttgttttgaaaagcttaatacgctaaaaaagccccgctatttcaaaacctggatgattcggattttaattaatgaatgtaataagattttaagtcattataagaaattcaactgggatgaagaaattcctctcatcggacaaatggatatgtctattgccgaatttgaatttaaagaaatgctcggacgtattgatgcgccttaccgcattattttactgctttactatgtagagggctttcgtatctccgaaattgccgaaattctggatttaaataaaaataccgtaaaaaccagactttcacgtggacgacaacaggcaaaaaaagaatatcttccaccagcttcaaaaaatgatactcttccacaaacaatttctattcaaacaagaaaggggtaaataatatgattgataacaagaaacttaaaacaacgttaactacaaattttcaacttccaaaacaagtcaatcaggcaaaggaagaagcgtttgcaaaaataaaggcatctaaagtctcagaagcagcaaaaacagaagtttcttctactatttcttctacttctgaaacagcttttgctcccaaaccagtttttacttctgaaacggattttatctccaaacccgatttcactcacactccttcaaaatccggttataagcaaaaattttacaagggttttgctgctatagctgcttctgctgccattttttccattatatgcaccgcaaatccagctctggctgataatattccggtggtaggaagcgtgttccagacacttggaaaatcacttggattctacggcgactttaaacattatgccaaaccgctcgacaacaacagttcaaaagattcttctgctgattccgatgcatctgcttcttccggtgaaactaacaccgcatccgattctctttacagccagacgcaaaatgggacaaccctgactttatccgaagtatactgcaatgacagcgcactttatttatctatgaccattcagactgaaaatgaatttccagactgttttttaaatcaggatcaaaaaccgattattttattcggcatggattctactttaaattatagcttcaaaaatacttctgaagataatacacttttaaatgcttatctggatggaaagcagattgattcccatacttatttcggcgttctgcgcctgaataaagaagatattttgactagtgaaaacgaatccattccagacaactttaatatccagcttaatgtaaaaaacatctgcggttataaaccggacgattctgctcctgaaatgccacaggacttaaaagatgcctatcagcaggctatggctgaaaatggtttagatgaagataattataaaaattttacggaagaacagcaagaaatcgaacaccggctttttacagaaatgtggaaccggtactatgaacgttatccggatgttacagaaggtctgaaccattataacacctggaccttagaaggggactggaatttttcagttgatattgagaaaaacacctccgactcgattacaaaggaaacaaaggcagttgattccgatggaaatggaatactttccgttaccaaaacacctttcgaaatttctcttgatgtaacagaccctgaatttaaatattttgctgttgtgcttgatgcagatggaatttactgtcagccaatggcacttccggctctgcatatacggttgctgttcaggacagcgatgtctcttctatctccgtttatttatgcgattatgatgaatatatggatgaactaaagggatattatttctcagaggattatcaggaaaaagccaaaacaaagacgtttaaacagcttctcgatgaacatgctgttgcaagtgatactattaactttaaaagataattactgctttatctaaccttaacaaatctaagataaaacccaggtactttcaatttccagtgctgaaagtacctgggtttttactctatgcttacggtattaggctgggtatgaaaacttactacctcacttcccaacgactccatttcttttgcattttcaggtgttgtatattttcccgtttcatcatacatcagccagtccggtgcatcaaaaaatgcaagttttggggaaacttcttcgtaaaaatcttttagaagcccgccatttccatgatgtcccatctgaatataatctgcttttaacttttctccccatgtatcaagcagataatcactcatcgcttttccaacatctgcacaaaacaacatactggatttttctccctgcaccttaaacatcatagaaccatcatttaaataatcctgtgataattcctttacatgttcatcataggcattataaatatcaactttaagcccgcagatattcagttcatctcccggataaacgtattttaaattttttacattcaaatccaaaaaatcattataagtatccacactatcccaatgtgcacgttcctgacacaatttcggtgacggcatatctaccgtataaacttccttgatttcaattccctgcaaatctgaataaattgcattaaacgctccaatatgatcttgatgtggatgggtcaaaatccatgcatctacttttccgcccatctctttaatcgtctgacgcacaaaatctgcatcttctgtccagccaccatctacaacaattaattgcccctttccaccatacaatgtataaaacatagaatttacatctcttggaccatattgtgtaatcagccatgtcctttccgtatcctcaattattttttcatactggataaatttaactgttatgattccgaataacaaaacgataatgaccagtgctacaccaatcattttgtttcttttttttgatttttttctcatcttttcctcatctaattttttatatcaattctccatcaaatgcttcactaatttcttcctttaattcaagaatgatttcctgatgattttttcccggaatcagctgaattaacttgattccttcctcttctttgtcaataatatttccttcatggtgtgttggatttaagacccatacacgatccacaggatttaatttgcgaagcacaaaattttcatccagccctctgcagtattttgaatgaagttcatttttatatccccgaatttgattttcacaaaatgacttcgtatccctattttgcttttttgttttatcctgaaagatactctgtatcttacgatattttacctcaaaaataatcgttgaccagtaaacatcttctctgtataagtccattcggatatcggggcgataatgtctgcctttcgtaaataccggctgattttcttttgttgtatcctctaactgcctgcacaatggttcatcataatgaagctttatccgaaattctcccttcacaaaccctacaaccgtacctgataaaactgcagatttcctgcaccgtttaccacacaattgctttcctttaaaccattttgcttcacttcttcttccgttgccaaaacacctagccagcttgtcttattttctttcataattcctatcttatcctatcttacttttttcttcttcgttacttgattcggttaaaatccgacattttcgacagtctttgttttccataaattgttttatttccattgcaggcaaacgcaatcatgcatacaattacaaaccacaccacatgttccggaccaaatacttcaactccaattaaaattggcgcaatcagggtatttgtcgcacttccaaaaacggctgcgtaaccaagtcctgccatcaataaaacaggcagacccaaagcagaagccagaatgaccccaagtgtcgcaccgattgagaaaagcggagtgacttctcccccctgaaatcctgctgcaagtgtcacaatcgtgaatactgcttttaataaaaaatcaaacacatagaccttttctcctgcaaaacttgcagaaatcagattcgttccaagtccacagtaacgtcctttccataaaagtaaaaacaaaattgaaaggatgatgcctgtaaagaaaatcctccggtaaggattttttataaatttcgccaatttttcttttgcaaatgccagaaaatacgaaaaggctccgcctgtaattccaaacacaatcgcaatcaaaatcaatttggcaatggtctgcggattcacagaaaacgtatccgaaaaagaaaccgaaaatttttccagtcccaataaatgagacgtgaaacttgcagtaaatgctgcactcattgccggaagcatcgcctcataaaataatgccccgacaactaatacttcaagtgcaaaaaaagtggctgcaagcggtgtctggaacaacccgccaaaacccgctgccatacccataatcaaaaagatttttccatttttttccgtctttccggaaatcacttcaaatttctttccgattgtatgagagactgctgcacctatctgaactgcaacaccctcccttccggcacttcctccaaataaatgcgtaagccaggtagaaaccataataattggaatcaatgccttcggaatttcttcattttcctcaaaaccggtttcgaaaatgagccccattcccttttgcgatttcgggctgattttttgatataataataaaattgccacaccggcaagcgccaaaaatggaacaagaacggtaacgtgttctcctcgaaatgccgtaatgcctaaaagtacccttccaaatatcgcatctactgctccaacgataattccaatcagaacacccatgattgtatagagcaaaaccggtatatattctcttatgcttaaatgcttcatttttctttgtctctctatctatttttttgcagaacagtttgtcagcttacattcgatttgaacttaatgaataaaatgggttgctactcgtttttctgtttccggcagaccaaatgtttcttttccaagtgcaatactcttcattaaaaatgtcatatttcttgcaagtgtacgcatggtctgttttccctcttcatccatctcagcttcacccacttttcttccgtgaatactgttccaatactgactggaagcaatcggcatgttggaaatagtaaaatatttattcagctcatcaaacgtagctgaacatccaccacgtcttgcgcagaccacacttgcacccactttcatcgttttatcaaatggtgtactgtaaaacagtcggtccagacatgcaatcaaagtcgcatttgcagaagcataataaaccggactggctaccacaagaccatccgcttcttcaaacttcgatgccagctcatttacgatatcatcattaatggaacatttcccgttcttatagcaataattacaggcaatgcatccacgaatggctttgtttccaatctgaatcgtttcatattccactccattttcggcaaataccttttccatttcttttactgcaacggttgtatttccgtctttgcgcggacttccatttaaaatcaatactttaaatttttctttcataagtcattcccctttcattaaataaagcgaacatttgcaatccgcttcgctacttgctcatgaacgcagtcgctttgcgatctgtcagtgggagctttcacctcccactgacagaagcatccccctcacccgccgcttagtgctctgcgcacttgaagcgggggaatgcttatctgcgttcaaaatattatttttattttatcacaacacgccctaattgactatatcctcccaaatgccaaaatgcttaggagttaaataaccgattgacagcagcaggaaacctaaggtaaaatattaataaactatatacctgtgacagtcatcagaaacagtaatgttttgagttaaaaagaaaatcagtgcaaatctgatacagatgattctactgtgagacacgcccccaaatatgcacaccggaggaacttcagtagcatatttttgcaggtcgttaagtcagagggcttgctgttacttcgttcaagatttttgaagaaaagaatcttttatacgcagtaacagcatttcataattttaatcaagtagtgtataaaagagctttgattcagaaatggagaaaggctcttttttgtgtataaaaaaatttttccaaaaaagagaagtgtatatagaaagtagaatacttaaaaaggagaaggagtatgaaaaaagaatttaagcgaatgcttagtattcttctggttctcacacttctaggaagtacgctgccgatgtctgtatccgcttccgcacttccggctgaaaacgcttctgcaatcgagaaccaggaaccaaccgatgcatcacaaaatgatacgcaaaatgatgcacaagatgtaacgcaaaacgaaacacaaaacgaagcacaaactgaagaagcacaagaatcccaacaggaagtacaagcttatgccaacacgcttccttccacaattccggccggggaaacttataccctgtctgaagatgtaacaatggaaagcggtcagtggtttgaaagtattgagggaaccttagacggagcaggacataccattaccctgaccgataagccactggcaaacaaggtaaccggaacgattcaaaatctgggtgtaacaagtgaaaaagtaattgaacgcgacgatactttcggaagcatggcaatgacttttagcggaaccattcaaaattgtttctctaccgctaagttaaatatgagcggctgggatgaaccgggcggattagtaggtactgcaaacggaggtgtgatccagaactcttattttgcaggtaccgtaaccggaatgctttccggtttttacggcggtttaattggtgtcaacaactcaaacgataccaaacttaaaaacagctgctatggacctggaagtatgaatggtgccgtaagtatgggtggcaacaaaatcactccggaaaacgtacagcaaaaatccttagaagattttaaatccggcgcagcaaacagcattttaaatactaatcttccggagaccggattttcctgggcaactccgacagatggcagcaatcagggatttccgattctcgtaaagggcggttctaccgaagcacagaaaccggataaaacaaacttacaaaaactggcagacacttgcagtgcccttaataaagaaggctatactaaagacagctggagtaaacttgaagatgcacttgcaaacgcacagaacgttttaaaaaatgaagatgctacacttgaagaggttacaaccgcaactgcaacactgcaggcagcaaaagacggtctgaaaaaagaacgaccgacagagccggtggcacctcctgctgacgcaagtcagattcagcatatctcaactgaaaatgatttaagtaagattaattccagttccgatcagtactatgtactggatcaagatattaccataaaagattcttacttctctatgacggaattcaatggcattttagatggacagggacatgccattatctttgaaaatgcaaactggatgttccagcatttaggggaagaaggcgttttacagaatctgtattttaccggtaccattgatacctgggaacaaagtggaaatggaccaatcggacaaaatttaaaaggaactgtcatcaactgtttttcagatgtaaaaggaagtttagcctgcggttttgcaaaacgtctgcaaggcggaagtattatcaacagctattccatcagcgaaggcaaaaaaggtgttttatttaatcagtataaagaaggcaccctgaaaaatacttactggcaggaaggacttgccaatccggctgaaattccggctgctgctttaaacaactcttctacaaaatcagaagaacagctgaaaaccaaagattttgtaacgctgttaaatcaaaacagaggagcaaatggcaccaaatgggggcaaaacagcaacggctacccttatttcggagaagataaaaattataatccggacaaaccaaatcttccggaaaacaaatatgaaatggttatggtaacggaagcaggcgaaacacttgccatcgaaaaccagacctttactgtttcaccggacgaagtaaatgcatttggaattgtaggaaacttccagttaaaaaacgtgccggaaaccagcacaatttcatggggcatttcagaagtaaaaccagaaggttccttaatgattggatccgacaacggcgaccttcgtatcgacaaagaaggatccgctaccgttactgcgacggaaacaaaggcagatggaagcagcgaagccgtagcctgggtcaaagtcatttcaaaagcgcaaaaattagaagcgatcaagctgtttatcgacggacaggatgtaaccaatcagacctgccaagttgccggctcagaagaaaagaaaatcgaagttaaagccaaatatcagggcagcgatgcttttgtgcctgcaaactcaactcgttttgcttacaaaaccagcgatgactcactcattaaaaactacaacgattcgagcagcttttcctttaaaaaacctggtaccgcaaaaatgattgtgacctcaaaagtaaacaatgctattaccgcagaggtggaagtgacttctacttatgtaccggcaacttctgtaaaacctgcgatttccggaaagaaagtcattcacggaagaaatgccaacgacccggatcagtatgcctttctcccggactacagtggcgtaattgtctctccacaaaatgcaagttatgcagataattggaaagtaacgagcagcgacgactccatcgccgaatatgtagaaagtatggtaaaaggatatgtaccatacaaagcaggtaccgttacttatcgtgcaacccttacacagaccgatccggagacaaaaaaagaatctaccgtatccggtacctctgatgtgacttatgcatatgaaaatccacttactgaagtaaccgcagtgcaagataaagtaagtatggaaaatttcacggaacaaccactggaattaactttcaagggcgaaaaatccgatgccggctggagcgttacttatccagacctgaaatggacctttgataaaaaaggtatcgttaagatttataaaaaagagccgattctgtggaaaaaaggcacagagtgggaaggcgcaccggatttcaattcggttgtcacaaatgatcaatattatgtaaaagcattaaaagaaggaacggttgtcgcaaccggtactcctcttgacaacacaaactccgccgctccgattcagattacaattgaagttgcaggcggtgaaactccacaaattaatatcgacgaactggtgcagaaaggtctgcttggcgcaaaagcacatttacaggcaatcagcccagaacagaattatgaatgtattgagcacgactggattgtttatgaccttcttcgtgccggaatcgccattccggaagaaaaacaaactcaatattatgattctgtagtaaaaaccgtgaaaggctggaaagcaaataagaaacctaccgaaattgagcgagttgccctcgtcttatctgtaatgaacaaagatattaccgatgtaggcggtgtcaatctcgcagaaatgatttataatcatccgaatttaaacagtggttctaacgaaacagcctgggcactcttagcactggatgccaagaaaacaccgattccatctgatgcgaaatggaatagagaacaaataatttccgcactgctgactttccagaatccggacaacggaggctttggattaaccgataacaaaactgcgggtgttgatacaaccgctatggcattacaggcactggcaccatacagacagaccaatgaggcggctaaaaatgcaattgatgccggtcttgcatatttaaaaagtgcaatgtccgattcctatgatatgggaactgcagaaagtacttcccaattattattaacactgattgcgctgcagattgatccattaaattccgattttggtacctcttatagtaacgcaattacaggcttaatggattactactgcgataccacaggtgcaactggtttctgccacgacaagactaataaaaaacgcaatgacatggccagtgtgcaggctttccaggcactgagtgcttatgttcactataaaaatggcggaaaattctattgggatttatcggaagatacaaaagaagttaccgctgcaaccgtaatgcaggcaattgatcagcttcctgaactgaacgagctgactttagaagacgaagcaaccgtacaggctatcgaaaacttgtatcagcagcttagtgaggaagaaaaacaaaaagtaacaaacctcgatgtattagaaaatgcacgaaagagaattgaagcactaaaagaccttggcgaccaaaaaggaaccgtttctctcactatcatggatggaatccaggcagacactcaggcactgagtgcaacagaagatccagccaccgtcagaggcactattctcgatgtgcaggttccaatctatgcacaagactctatgatgagcattattcagcgcgcttgtgaagaaaatgaaatcgatatttcccttcgattccagggcacttatatcgaacgaatcgacggactgtccgaatttgaccgaggctcgggaagtggttggaaaggtaccttagatggcgtcttcccagataaaagttttgctcaatgtaccgtacaaaacggggaagtaaaagatcactctgtgattactgtagagtacaccgaaaatcttggtgaagatttggaagcaaatgctgaattaaaaacactgggcttacagggcggtaatttaaaagaaacctttgagagagaccgttatgagtatactctgctcacaaaccaggatgaaatttctttcacacctgaatttttcaatcgctacagtgttgcaagcattgaagccgacggtgttgcgtatggtgtatctcaacagattccggttgaagtcggaacacagattcagctggtttccgaaaagaatgtgcgaggaactgaccgcagaacttataccttccttgtagaagcacaaggagaagaaaaaccgggtgagcaagaaaagccggacactcctgaaaaaccgggcgaatcggaaaaaccgggtgaatcagaaaaacctgacgaccagcaaacatccgttactctgctgtcaaataaaaagtatggtatttccttaaaaggtgaaggtctgacagatgatatggaactttctgtaaaaccgattaaaaatgaccacgaagatgttgctctgatgaaaaaagagcttccgacaaacaaatctttattctgcttatatgaagtgaaacttctgaagaacggaaaagagattcgtctcccgaagaaagcaacactttctgtttcggtcggaaaagaatatgaaggaaaagaaatgacccttttacattgtgtaaacgaaaaagtagagtctttaaaaggcacagtaaaagataaagtgctttccgtagaaatcaacagccttggcagcattggtgtggtaacggatgtcgctaaaacacaaaacggaaacaataaaactaccagtggaaacaataaaactaccgttggaaacggtaacacaaagaaatctccaggcgcaacagcagcaggaagtggcaacgctacttctgccggcaaatccgttaagaccggagatgagttaccacttggcgttacgcttttgatgcttttggtatctgcgggagctttaggcaccgtgggttataaaaaaagaaaagagagaaaataaagcactgcaaaaagtaagctaacacatttattaatgcctccatagaaaatatgggggcatttttttacgcttttttaaaccagcagtttaatgacaaatctttctttttactctatactaagtattgtcagcaagagagattacaaaaaaacgaattgaatatttgaatcatacctgcgatcaactcgatgaataaagtacgccagtacttcgaggtgtgtggtaaatccaatagacccggaaacgggtgaggggcgcccagtcaaccaaatcaaggatacttcttttggaaggctgccggggtttagtgataaatcccgggaagacggaaaccatcaacggaaacacatatcgcagaaatgcccgcatttaaaagcacggaacttctggatgcagcaatagacgcctacggtgtaggagtaagcctaaggggtatcagtgtggcaactgatatgacagaggtaaagccaacaatgcattctgccttgatgacggagaaatccgcctataacagaagtcgccggtgaaagtagccatatggcagattgacaaaaactcgtttattaatctgaatggacggtgaaatttacaggtagccaatcctgtgcaggcttgtggcgtaagccaagggtaagaagttaggggtcgctccccgaagctcagacttatcttcctggtggcagaatataagtgaagggcacggattgtacggcgaaggccggatcgtaggtatgattcagatattcaaagatttaaacaaggtcgttccgcctcaatcattttctgagacggaacgaccctttttttcgtacattcttatgctccaaattctatttttttcaccagataatctgctgtttcctcttaactatttcaatacttcacaatttttcaagcaccactccattccaattttcttctttccgaccattctaaaatcaaccatcaatgaagttttctcaactttaacgatttttccttttccataaattttatgtttaatccaatctcctgctttgataccttcagaaattttggcttcttcttttctaggagctgtctgtactggctgtccttttgaatttactccaaacaactctgcaaaagtatcaaaatcttttactttttctaccagacctgctcgatacaatcctacaaaacacgctgctgcctttgcctgacagttaatacttttggatggattaaactcaatatctgtaaatgcatcatattttaaaatttcttccacaagtttctcattttccaataatgcatttatataaatataatcataaaaaattgtctttggttcaagtggataaactctgttttcaaatataaatccagtcagcataccactggtaactaatcgtccatctcgttttgcttctcttggagaaacttccaaaatatctttatatggtccacctttttggaatgtttttgctgactgaaatacacattccaccggtactttcttcccgagttctggaacatatttctggaggaaaaaggcactcaaatcatttccatattcctgcatggatttacttgaaatttctaaaatttttttatctggttttcttcttaaaaactcattatgcatcgcagtaatattcttctgtttctgtacctttgcaaagccactattccagtcaaaatcaattgtcattgttctataaaacggtgctgattctttcgctacaaaaactggtctgtttgccataatagccctccactcattttctcttttcatcaggttattttgttgagtttattatagcatgaatttttatgaaaaaaatcaactaatagtttaatttaccgtggaaatactgttctctagttcaattttatttgcaaatattcttctgttgtcataatacttaaatgcaacggcgctaatccctctaagacttttattgtggcttcttctgtttcattatttacaccggcaactgcatctttaaggtaaattacatagactccagcatctatcaagctcataaccgtcgataatacacaacattcagcaactactcctgttacaacaacgcaagaggcattggatgcagcttttcttatttgttctatgctataagatgaatacacggattttgaataacatttatattttttctgtaaccctttaaaatcatccacaagttcatttagccatttatctgaattaacatctgaattttcaatattataatttttccaaattccctgaggttcatcggatgcgatgtattttgtgaaaattattttttcttctgtgtttgattctaataatttttttatctgattaagagagcgattaaaattagaacactcccatttttgtccatttgaatatacattttgcatgtcaattacaagtaaaagtggattttccaataattgtttattcatacatttacctcatgtcaaaatttgattttatgttttgatagaaaaataacattttaagatttaatgatggtatatcataaatttcaatcccttataggtaatgtgcaacaacagcatttcttagaaatcgccaaattcaccttgagactgaccgactttttattttcttcccttccaattaattttcttcattactttctgaactgcattcactactttcgacgacaaatacaccttaggaagttttcgttttgaatacgcccagacggaattattctgtgttttatttgtcaatacctctgtaaaaaacctttcccagctaacatactctttactttcaatataattttctggttttttgagaatatctgttatttccttatctgaaattacatttgacgcaagcaaaagccattcaaaagattctggtgcatataagacaacattttcaaatacatttacatattccataacctctttcatttcagaaccaaatgctgcaccatctacaattaccaattttattttactgtcattttgatttgcctgtaaagtcctaataatattagatttacctttcgcagaaacacatggtattgctttaactttcgacaattctgaaaaaaaatcatatcctgaattagaatcctcggtaataacatattcagggtcgacatttccttcttctgtcaattctccatagatatgataaatttcattgtacttctgttttgcttcatgaaattttcctgattttcgaaatccataaatttcatttacactgtatggaagcattggcagtttttcacgtgtcgcaatcacaaaatagttatccgatttttgtacgacacctgcaaattcttttgaaaataaaaaacgatttccctcatcaataaatataatactgcttgatatctcttcaatttgtcgtttccaatcttcattatctattatcctgcattcacaatcacaggaaacaaagacaccactgtctgctccatatcttctataatctcgaatcaagtcaatcaatactgtttttccagaaccactatttcctgtaagaatggtgatatttctttttacaacaaaatcatattttacttttcttgattcaacaataattctatgcgcacctctcatactactactcctgtaccatttgatttaggtatttacttgctataggaatcagctctttcatagaatgaacaacttctccaccattttttatttttatttcaaaatcagtgtcttttccaaagttcatcatgtgcctgagattaattgttaaatccttctgtttcgctatttctaaaatccattttgcacaattatcaccacaagtagatgcattaaaaattctatcaggttcatttagcattaatagtaacgttttcactccacctgataaccgctctggaggtatttgaccaagaactggacttttaatacattctccacccaatacttcagaatcatctacatcttgaatcatctttttagcaagttctgattcaagccactctgattcataagtgtttttaaaataaacatttgtattataaatacttctgggttcgtctccatatataattgtaagcatattttcccctccggaataatttaaaatactaatttctatttattatcttatcccatcgaaagctaaatatcaatgagaacagtgttttctaactttttgattatccatgagactgaccgactttttatttcgttttctttctattgaactggtatctccggcaaacgtttcctatcttaactttttcaaatacttttctgatatactttccatctttttttagaaaagcatctcctgattccactcatatcccaacatttctgcaatacgaactgccaattcgatgtctaccatatcgctaatcacacctaatgccatatcaaatccagccatcgttgaactgcaggaataaaattttccatcggatatccagttcacaccctctgctcgtctaatttcagcagtaaacattcgtttccagttctgatctcccggataatctgcaatctgtctatgatacaaaagcccggtctgtgctaatatagaagaagcatttgcaatcatcatacagatatctgcctcctgtgctgccgcttttataatttccaattttttcggttcaagacaaagcagcttcgttgcagtacgccctcccggaagtaccaatatatcttccacttcttccggaatcaatagttccgtccaaaccttcacaccttgtttactgctaaccagtcctccgtttaccgacaaataattaatataaaaatgttccggtgccattccaaaaatattagcaattcctaaggcgtctaacgtttcaaactcatcataaagaacaatatttacattcatcagtggatcccctttcgcatcactccaataatatttttattttatcaaatctcttgttctctaacaagccatacagggggataagttactcagaactcggaattttattcgccaaaagccgaacaactgtctaccaattatacttatctgtgatataatagtcgaaagataatcatattcaaacaggaaggatagatatactatgtttcagatttttgtagactctgctgccaatcttccggctgtaatagcaaaacaatataacatcaatgtcatctcttttattaatctgattgacggaaaagaagttacctgctataatccagagctttctttagaagaagaacgccaaaagggtaccgaatattataatgccatgcgcaaaggctgtgaaatcaaaaccggactgatcagcactgcaacatttgaggaacaattccaaaaagcatttgaaaaagaccaggatgttttatatttttctttaagcaaaaatatcagtggaaactttaactctgcacgcttagctgcagaagaagtgttaagtaaacatacaaacggccgcaaaatacgcttaattgactctctcaatgcgtctcttgcgcagggaatccttgcaatctacgccagtatcatgagagaaaaagggatggagattgacgaagttgccgattttttggagacttgcgtaggaaagatgaacggtatcttcacagttggcgatttgaaatatctctcccgcaccggacgcatcaagggaagcgtagcaacaattggaaatatgcttaagattaaaccgattttaaagggagataaagatggctatattgtcacttataaaaaggtgcgtggtcgtaaagccgctttaaatacactggttgatctggtttgcaataatatcgtagagcctgaaaaacagattatcggtatcgctcacgcggatgcttatgaagaatctctgtatgttatgaacaaaatacaggaaaaaattaaagtccgtgattttatcaacacttcctatgacttctgtacaggaagccatgtaggacctgatacaattgcacttttctttatcggaaacgatcgagaacttgctaacgagtgattataaaaaataccaagaggggcgtgaaaaatagctttgttcacacccctcttaactcatcactgacgaatatccacaatgcctgtttccagtgtactatccacaaactcgctgctgcttccatttccggataaattaaggtacatgttcgaaagttgattttcatccacaatccatgccatttctatctgaacacactctcctgattttaaggacgaaatatagtttccaccatttccataagcttcctgtacactgtaataatccatttcaaatgctttcgctacactgctcgaatgaatacaatcataattatctcccgattgctcattttcgatatacaattgataagtgtcaccttttgatttcagcaacatcagatttccgagatataatatatgattcaatgtaacttctgaattattcttataagttgccgtcacaaataccagtttttgtttcacattctcggttttcacaacttcatccagaacttctacaccatctccggtctttatataagaaagctgattttctactaattttccatcctcgccaactgcctttttccattcttccggaatcttattttcatctaataaacttaaatcatctgaaatctgaaccgaatccacttttaccgatacatcttccgattcgattgaattgccattttcatcttctgcagaaacgtctggggaaatcttaaattcttctcctgttttccagagtttcaattcatccgatgacacactcgttaccatttctctggtttctgtttccggctccgttgatacaaaatcactccagctgtacatatcttttgtcgcaaccatcttatctgttttaacaagagaaatattttcagcaaattttaccgcttcctcctttgacatatcatctcccacataaatgactgccatccggtattcatccggacacatcagataaatcctctggttatacgaaccactctgctccaaatcctgataccgaagataaacaccctcgtattttccaaaatttctttcttcactttctaccacatgattgtccgttaatacgctttcaaaatcctgtttatccaacagcatcaggctcattgaaaacccaccctgatacggtgtttccaaattagaaaattttccttcttctacctcttccatcccatccggaaggtagcctgcctgaatttttacgtctggaatttcatccggaatcgcagtcattttgctctgttcattggctgaaatctttgttgccaccttataagttccctgtttttccaaatgcatcgcataccatttggaaccggcataaacacttgtcgatacgcctaaaatacaaactgcggcgactgctgccacacgagttctgctccattttgttttcttagcattttttgttggaaataccgcaatctgctcattttccatctgtttttttatttcatcctgaatccgattatgaatcatttccggagtttttggcatttctttcttgatatcttctaatttcatacgaacacctccttatgttcaaatgctttttttaactttccacgggctcttgccagacgcttttgcactgcaccttctgttatttctaaaatctctgcaatttctctgatactaaaatcttccgcataatataaaataaccggaagttttaactcatcctttagttcagaaaccgcctgatacaattcactgtaatctgttttttccggctgttttcgctccggtatctctgtcgtttccatcgatacatattttttctgcctgcgaagcagactataacactcattaattaaaatccgaatcagccaggttttcgcatagttttcttttttcagcgtttccctcttttcaaatgccttcacaatggtttctgaaattgcatctgcacaatcctcatcatttccaagaatgatttttgcagtagcatataattgattttctgaatttaaaatcaactctcctaaattttctttcgtcaaaatatcaccacccttttctcgccggctgttcaatttcaagtcgaacactcgtgagacttggcgcgcgattctagtcagcacaagctgacaaattcttcttagaatcgctgcggtctacacttcgttacggtccgcgcagaaccattgtccattggacaatgtgcgccccacagagtgtttatctcagtcgtagtcttatcgactgagataaatttgaatgcaatgttttcttacatagattagacgtttatgaaaagaaaatatcccttttattctattatttttttattttgtaacctttttcctttctcatttgtgttataaatgaaaggacctttcaaaatataataggggtaaaaaactcatgagacaatccattcaggaattgattgaacgttatcagaataatctttatgcaattgcatttaacatctgcaaaaatccatccgatgcgcaggatgtcgttcaagatacgttcattcaatattatacaagcaaaaaagaatttgaagacgaacaacatctgcgagcatggctgattcgtgttgcaattaataaatcgaaaaatatgactcttactttctggcatcagcataaagtttctttggaagaatacatggaaactttaacttttgaaacacctgaatcagaaaatcttttcgaggaagtcatgaagcttccaaaaaaataccgaatcgtcattcatttattttattatgaggattattccgttaaggaaatcgcagaaattttaaagttatcacaaagcaacgtaaaagttcgtttatcacgcgcaagagcactgctcaaagaatcattaaagggggaatggaattatgacgaataaagaaaaatataaacaggctttttctggattgcatcccttagaaccaatttctctggaggtaacacaaatggtaaaaatgcacaagaaacacaaatttcaagtcgctgctgcaatccttaccgcattcattttagtcggaggcaccggaactgtatacgcagcaaatgttggcggaatccagcgtaccattcagctctggattcacggagaccagactgatgccacactcgatgtaaaagaagatggctcttataacttgaattattctgatgaaaatggaaatacagtagagcagggcggtggcggagtcgcatttgatgccgacggaacagaacgcccgcttacagaagatgaaatcatggaacagattaatatgcctgaagtagaatacgaagaagatggaagtgtctgggtttattacgaaaatcaaaaaatcgaaatcaccgataaatttgataatgataaaatctgctatgtgaaaattaaaggcaaagaaaagactctttatttaactgtaaaataccagaatggctactgcatttcagaagataaatacccaaaccctgcttcttttaactgattttttatttttcatacaaagcaagagcagttcagaaaattcattctgaactgctctgctttatttttacaagctctctgtaagagactgtaaattaattcactgattttttcttagcagatttctactaattcaatcttaaagtttaattcttttcccgccatttcatggttcgcatcaaaagtaatcacaccattttcttttgaaacaactttaaccgggaatggctgtcccattgcgttctgaagataaacctgctgacctgcttctaattcttcagaacctggaagttcactgatctgaacactgaaaactgcatccgggtttgccattccataagcctcttccggcattaaatgaatgtctacgacatcgccaacttccatatctacaaccgctttatcaaatcctttaatcatcattccagctccgctgataaattcaagcggttcaccacggtcataagaagaatcaaattttgttccatcattaaaagtacctgtgtaatgtactcttactgtttttcctgcattttttccctctaaaataatctgtggagttccacatccatggcatccgccaccgcaatctccaccacagctatgaccttcttcatggtctccacagctgtgaccttcttcatgatgatggtcacaagttacaccggcatcttccagagttccatctaaataatcctgaactgctttatctgtgtcacctgctgcacctgcacacacttcaattcctgcttcagcaagagcggtctgcgctccaccgccaagacctccgcagattaaaacatctacaccctggtcagctaatacacccgctaaggcaccatgaccacttccgttagaactgattacttcactggaaatgattttgttgtcttctacttcgtatactttaaagttttctgttttgccaaaatgctgaaatacttctccattatcataagttactgcgattttcattgtttgtattcctttcgttctcatataattctgatattttttctatagttcatatgataacatagattgtaaggaaaagctatttgttatttacatttcaatatgtttctattatttcatgtacattcaaaaattcatttttaatttttacattatttacattccaatatgtttctattatttctgtatgcgacaaaaaaggaccgaaaatggaaagtgcatttacattccaatatgtttctattatttcgagtcaaaaaggtctgtaatatgacatttcagacctcatttacattccaatatgtttctattatttcgagaattcatccaatgaaagcatttcttgaagaataatttacattccaatatgtttctattatttctaattcttccgtagcacattctaatacagcactgagatttacattccaatatgtttctattattcatcacctgaccaaccgttagtaccgattttaccgattttacattccaatatgtttctattattcaggaatgtgcatacaagcacattatgcgcatcctttttttacattccaatatgtttctattattcgacgattcaggtggattctatgaggtgcggacaggattttacattccaatatgtttctattattcccgtccaatgtagccttttataattccactactattctaccatcttttgtcgaccctgtcattatcttctgttttttcaataaaatcttctctttctttcctaaactctgcatttttcctgcaaagcgtcaattgtcgactccacgccttttttaccttatcacaggtcgacaattttctttctatatgaattctccatctgtttccaattcttcttgcataataagccccatgccttttcctgtttcaaactcaaactcatatttgtatgttgccctatggatatccataacttttcgttttcttccattaccaattgtttttttatcaactttttcagggaatttttgataaattggcagactgagtgttaaatcctggagttttgattttattagacttctcgtttctcttccaatgtttggtttactcaaaaattctattcctacatcaaatacttcttttttttcttgataaattcgttcaggaacaatcgtaatactgttaatatttcttacttctgcttcttttgccagatattccgtaggatgaatatttttaaaaagttttaaatattcttttatttcttgaaaatattgtgttccttcaattttttcaatatcatacactgcattcatataatctgttttcatcttttcagtaaacagttttccctcatagtctttcaaaagttctaacgcccgctcatataaatccttttcgtatacactgttttttccaaccccattttcactagcatatacatgaatatttgcttctgatggacaatatcttccttttcgattacatcttcccattcgctgtaagagactatctgctgtagacatttctgtgtataaaacatcaaaatctatatccagacttgcttctactatttgcgttgtaatccagacacctgttttatccgattctgaaaactccataatatttttttccagcagtgctctgtctcgtcttaaatatcttgaatgaagaagccatacattttcactttttaattccttataatgtcgttgtgcttctaaaacagtattgcaaatgactaatacttttttatgttttccctgttccaagatttcattatacacactcttatcaattttagaatcatgaatttttactctgtgtctggagttaatttctttctcctctacatctgatgtaaaatcttcaaaagagtattctagcccacattctttcatgaaatgctgaagaactggtgaaaatgtagctgtgataatggcaaattttccacccattttttgaattattgataatccatagacaatcgtcgcaataactcgtggttcatacgcctgtatttcatctataattagttttgaatattttaatgttgccgcaaatatttccgttccaagtgcccgataaacaaatttaaataactggtctgccgtgcatacagtcaacggctgtgacagcattttcgcacggtcatatttttcgcaaattccggcttcttcctgtttgtattcttttaaatatttcgccatactgtctgaatgaagcaatgctacatcttcataagagtatttttctcttactcgattataaatcgcattcgatgaaacctttaacggaagagtataaaatcctttttctccgtttagccaaagtaaggctgcctctgtttttccggaaccagtaggggctaccacaaccagattcttatctttattgtttatcataaaactctgtgctggtttcaagctatattgctttaaaatgtttgtggattcgtctgcatttccttcttccattttctgagattctaatttatattgatttaaaatatttgactttaatttcttttcatgtaaatctaccgcagtttctgcttcttcataacctgcacttacggtataatcaaatttattcagcataccttttataagcagatatttattccagatttctgaccaattttcgtactggtattccactattttactgctgtaaaggttgttccgaaataagagtttatagatattgctacagtacaatttgctaatatctttatttaaatattcgcttacctgctgcatataatattttcttccatattctctgattttttctccatcgtaatcatcttccctatcgtgatgataataaatggctgtaataaatggactaaaatcttcttctgaaaactcttctgataattttaaaaactcgctttttgaaagcgtaactgcacttaaaaatccatgcggaatctgctctagctttctgctgtctaactttgtttcttcatccacttccggattgaacatcagtgcttgaaatagaagattcgcttttccccaatcgtgtcttttacaggcttctaaaatcaacaatttttctctgtctgaaaaatatgctccatactgcttaaaaaatgcttccgcacatctgacaatttcttcttcatgctcttttaaagttttttgtttttcttctaaatctttacctaaatcgtctattgtatgatttataatatttatctctgtctcatcaagttcttcttgaagtttttccttaatcttctctaaatcttcttttaacttgtctttttctccttgagataactgccttttctttgtttttgcataatattccatagttccactcttttctggaacagcattatttttttataatactgttccttaaatgattaatataaaactattgctgcatctttttcatgttctgcatctttactttttttatttccatctttttcattttctgcttctctaatttctgcataattgtccgtatatgcgcctgtttctaacgtagtcccttttggacaataatatgctttcactcttcccccttcttttttccagcgtcgaagtccctgttttgtaatttcatattcacgggtcaagctatatacggtcatttgtttatttggaagttcaattttatcctcactgtttttccattcccattctaccggtatatacatatcccgttttaaatctacttcgtcctctcgatgaatttctacaatatcaactcgttcaatatccagtaaatcttcataacgacccaatgacaaatattgaggtggattttttaatgcatgatagactgtcataaaatcttcttcatttggaacaatatgaatcaccaaatgattctcacaaatgagttccacatttgcaattcccttaaacgctccatattttgttccgttatcttcaatgcagatattatgtctgccttctttaaattttgttcctgctgaaaaggtatatctcgtataaagttctgaaatcattccgctgtttgttccttgaatacaaagtttcatcggatgaaattctgtataaccacatgcagcatgaatcattccaagaacagtcgaatacggaggtaatggaaatgtctcttttatgataaaactacttggttttctataattcacaagattttgaaaacactgtaatctaattgctctctccatagtaactatccacttctttctttaaatgtttaaatacagttcccacagatttcgcttttaactctgctttgatttcagtttcattatcaaaaattccagatgtaattccaacaactgtgttttcttctatctcattgtcttcaatcagttctaatagtgtttccacattaattttattaccctctaatttaattctgttctcaaagaatggattctttctttgatatcttccgccaataataaataatggactcaaattttctcttctgcctctaatatctctatataaataatgcaaagaatctaacaatacttttacacgttctgctttttcctgacttggaatatcaatctctccatctactcccactctgtccaaatcaattgacacagtatacgcataataggaacgatgaatttcactctgtgcgattccattttctagtttttgccttacagcaagaccagcatttgtaagaaattccagatttccctgaaatggttctaacgcaatcgcattactcagtcttacaactgcacttctagtcgttgctccacctttctctttttcatcaccttttgatgttgttttcatataaccaaacatgtcaatctccggataatctttaattgtagcagatggtgcaaattgaactactttcttttgagcctgaaccggtgtattatcccaatttgcctgctgtacaatattgtaacgcattgcttgtctggaaatataagaatattgccaatcattccctcttgtcattttcttcaaagaagaaacattattaattccttctccatagtttgcactttctgctaaaaaaatcattgtaattgtaaatccatctctcttcatttaattattctcctttttcccttcgtaacagcctatcaatccagctacaaatgcatatccataagtagtaaacttttctttatcttccaacatttctattatacctgtcggtattaaaagctctggtccattttcattctttcttgaaccataagaactgtacaatctaaatacaacatccataaatctgtccacattttttacatacaacgcatttaataattgatattcaacccctcttaagcaatctccagaactggttcccttagcctgcataattacttttcttaaatctgatccgttttttttcataattccacaatccataataatctcctttcttttctcagctttatctacaatttcataccataattgaatttcataaatacaactagcataaaatttaaaaaattcatcctcaatacactcccttaatacacgatttaataactgatattgattacgctgttgaagcaaatttttaatcacactttcatataagtttggaatttcatttcccacttttacttttgaagaatctgcaaaccgttgtaataccgtcgctacacttggtttacctatcgttttcagcatatgtttatttataatacttagaatatacttatcttcatcctttgttcctcgtaaaattacttgtacattagaaaattcctgtagtttttctttcagtaaaatattaatagaccttgcaaaccacgcagaatatctttcattttcctttttttcaccatccacactggattttcctgattttgagtttgcagctatcaagacattgatattgttatttatatttacaaacacaaatttatctgcaaacaagcagaatcctaatggacttaatgcataaacaaaagcacaagcaggacaaagaaatgcatccactttacagttccaaaaagcagaacgttttcttgtaaaatcatctcccatttcattcataaatgcaatagaaaccttttcttttgcatttattggctcaccacaatctatgcataaatcttttgcttttttatggtctgctttcaaataactccgaaatggttctgaaaaatctttttcaaatagttcccacatatctttttttgcatttgcccgcagtaaaaaacattttccatcccaaaagcgattaatgtaagtatacaccacacttttcataataaaagtttcctcgcattttggctgtttcaaaaattcctgtaattcactcaaacgcttctgaagttcttctactggcagtttatcactcaacttttctttctttaattttaaataaacatctggtgctttaatcttatctttgatgttttcaaacccagcctgataactattcgaaagcagtttatcattgataaattttaaatcttctttctctgctttttctggactccattctccctcagtaattttgtccaagcatcgtcctattctgtccattactccctgatacaccgtagacgaaccaaaatattcaacaaatgccttaaaagccatatccgtccactttgcatcttctgcgaatttacgattaagccataatccctgtgcatcttctgtgattccataatccacatctcttcgagcacctgctgtttccaacaggtactccatccctacaattccagcgttcttcaaaaaatcgcccattgtaattacatagcgttccaccaaaccatcccctttctgaattaagaaaatttagaataaaacagaaaattttccatgtgcctcacttcgtctgcttcccagtcctgctgcatataataaatttaacagttccggatttccagttaacttataaattcctatgctttgatccgtataacgtgacatcacttttgaaaccaccttcttcccttttaacggagtaatagaaaaattgctgatatccatattaatattcagcttttctaaaaacactcttaaattttccttcaccatagaaggaaactctgcatcttcacaagtataataaatatctgtgttatcctctgaattgtgttttctcacaatcaaagaactctgcatttttataataatttcagtatctttaatttcttgaagattttgcgcttttattgctactaatttcatagaatttttattcatcgggtgtgatttattcttcatcaaactaaacgcattataaaactttaacagctccgccatattcgcatccgaaaacgatataaaaaatttatttccccttattcggattgtttcagttccaaatctggcttctggtaaaaaaaacgaccaactgtaggttttgattacagatttctttttcgtataaagctcctcaaaccactcggatgaataatttttgacagaagctttgaaaaaactcaaacctgtacggtccacctccaatggaagttctggattttcaacttcaaattctaggtttaattcggtcatagttgttttcctcttttcttttttccgaaaggactcttcttttttctcatagtaacactatgtttacaaaaaatcaatcatttttataattaatacaattttaatggtttaataaaataccaaaattaaagtcttcctttttttatctttttcgattacaatataggtgttacattttggaatgtaaatttaaatttgtaataatttatactttaaaatagtcccatattggaatgtacaaagaaaagattgcatttcgtaaattgaatgcaatcttttcttttgattttccctcacatttttcactatctccctcacacatatccatagattttttgctactactcattataatgaaactgatattaaaagtattttttattgggggaaaatcaatgaattcatctactataaaacgaatcattatgacttttgttggaatttttcttaccagcattagtgtttctatctttaaagcgtccctgtttggaactgacccattttcctgttttgcaattggaatctggaatgtttcccacataaaatacagtgtcgcttatataattctaaatgccgttcttttactcggtgtttttgtcttagataaacattatattggactcggaactttattaaatctgttttttgccggatatatcgtagaaaaaggtatgcagctttttgatttatatctgccacagagaactctgccagtccgtattttattactcgctattgcagttgttttagtgtgttttgcttcggccctttattttacggctgatatgggtgtctccacttacgatgcctgtgcactcatgattacaaaaaagacaaaactgccatttcgtgtatgccgaattggaacggaccttattgtcacaactctcggattctttatgggcgcaactgtcggcattggaacgcttgtcactgcatttggtatgggacctttaattgatttctttaaccgtacctgtgcaagaccgattctttatcacaaaacatcagaaatttcattattaaaacgctctgcaatgcattaagctttttacaccatatcaaaatccgtgtgcctcttttttaggagacacacggatttttttactctttttttgacattaccatttgactttttggtattatcagtggtagaatacataaaaaataaaggaacctcatatcctatatgctgcctgcgacatataccatacgatattcccttatcatttataaaacagcaaaacatagataggagactttttagaatgtttgaacaacaatttattaacttcatggaaaaatttgactctgtaccttttacaatcaaaacacaagatcacacctatcaaattggaaaaggagagcctacattttctgttttctttcacaaagtgccaagcatgtctgatttgcttaccagcacttctattgccctaggcgaagcgtatatgaacggtgatattgaaatcgagggtgatttatataatgccctaaacatgttcttaggtcagcttggaaaattttcaactgactctaaaaaattaaaacgccttatttttccttctctttctaaaaaaacacaaaaagaagaagtttcttcccactacgatatcggaaatgatttttataaattatggcttgatgatactttaagttattcctgcggatatttttccaaagatacagatactttatacgatgcgcagtgcaacaaagttgaccgaattttggagaaattatatttaaaagaaggaatgacgctctgtgatattggatgtggatggggcttcttattaattgaagccgccaaaaaataccatgttcacggtgtgggaatcacattgagccaggaacaaaagaaaaaatttgaggaacgaatccatgaagaacatttagaaaatctgctggaagttcatttacttgactatcgtgatcttccaaaatctaaaagaaaatttgaccgaattgtcagcgtcggtatgctggaacacgttggacgtggcaactatgaagaatttatgtcctgtgtaaaaagtgttttaaaaccgggcggattattccttctccactatatcagtgccctgcaggaacatcctggagatgcatggatcaaaaaatacattttcccgggcggagttattccaagtcttcgtgaaattattcagattgccggtgacatgcgtttttatacaattgatgtagaaagtctccgcagacactataataagacgcttcttgaatggaataaaaacttccaggctcatagagcagaagttgtagaaatgttcgatgaaaaatttgcccgtatgtgggaattgtatttatgcgcctgcgctgctactttccaaaatggcattattgatttgagccagattttatttaccaatgatgtgaataatgatttgccaatgacgagatggtattaaattttcaaaaaatccctaaagagaaatgctattctttctcttcagggatttctttttacttaaaaaacacagcatcatcataggtggtatcgtatatggtgtcaatcaatttattattttaattgcactatttatttatatttcacagccgttccataagcaatcacttctgctgctccagccataacctgtgaagaaccatatttcacaccgataaccgcatcggcatccatctcttttgcttcatccaccatacgcttcgttgcaatctgtcttgcttcgttgagcatttccgtataacctacgatttctccaccgacaagagttttcattcctgccataaaatctcttcccacattttttgtctgtacaacagttccttttacgattcccagcgcttcaaattccactcccggaatatattcaatacttagaagcttcatcttcttctcctccttcaatctctttcattctgcctgcaagtgcaatccaaagtccaattatcaatgccacaggtattgcaattaaaaataccaaaagcccaagtggtattgggtcctgcgaatttccccacagcataaatccaatggtaagtgccataagtacagtcataaccactgccccaatgattgcaccttttctttttttcttatgaacatccattttgtttacgttcataaactttgcaccctctttctccatctgttcaatttcttccagacattcttccgcatttagagtttccaaagattgatgttccgagatgaggcgttcacagatatcctgcattttcgtaagtccttctttgcgatattccagttcttttaaatgctgttcaaggcaaatctgcaggcttttcttcttttcaaaaagagctttcatttcttcaatagagagatccattttccgaaataacttaatttcctgaagtctggcaatatcttctttatgatattcccgatatccgttttctgcacgttccacatcaagaagtccctgtgattcataaaaacgaatattcttttttgtaatccctaccagttcttccacctgtttgattttcatttttattccgtcccttctcttccgacattttttgaaaatctgtctgcgttgtttctttgtctgtaccttgtttatacgacttccataaggtggaaggtcaagtattttttgagaaaattttgaaaaataaaacattccagtcagcgtacacttagaaatctatgcggtttcacattttacttcacacttttttacttctcataattgcaaaaatagaactaagcagaagtaacatcggataaaacaatttcggcataatctgaaatgcagaaatttctccacccagttcatttaccgctgaaattgccacaagcatctgcgcaccgtaaggaatgactccctgaaaaatacaggaaaacgtatccagaatcgaagctgtctttcttggagtaattccatattcctctgccatctcttttgcgattgggttcgccatgacaatcgctacggtattatttgccgttgcaatatccatcgttccaaccaaaagtcccattccaatctgaccgcctttttttcctcggaaaattttatgaatccagctaagcagagcatcaaatccaccatattctcgaattaacgcacacattgcagccactaaaatcgctaccatgcaggtttcaaacattccggatactccagaacccatgttggtaagtaaatcaaccggcgtcgtatgtccgcctatcagcataataaatgccccggaaacaatacctgtcaaaagcacgacaaatacattaattccaataattcctccaattaataccagtacataaggcaatacctgaaccagatgataagactggctgacatgcccctgaatttctgtctgaaaagataaaaccaaaatcaaaatcagtgttgctactgctgccggaaatgcaatccagaaattttcacggaatttatctttcatttcacagccctgtccattacaggcggcaatcgttgtatcagaaataaatgaaagattgtctccaaacattgctcctcccataacggacgccacacaaaatgccagattaaatcctgacgcctgcgaaactgctgccgcaatcggagtcaacaaagtaatcgttccaaccgaagttcccattgccactgatacaaaacaggcaactacaaataatacggctactgagaaccttgccggaatcagactcaacataaaatatgccacactctccgcactgcttcttccgacaacaccgacaaaagaacctgctgccagaaaaatcaaaagcatcgtgataatatttttatctccgactccctgtgccataacttccagtttcttatcaaaactcaactcccgattttgcagacatgctacaagaattgcagcaagaaatgcaactacaatcggcacattataaaatcccatcggaattttcatcacatactcaaataaaattccaagaccgagatataatacaagaaatacaccgattggcaataacgcaattccttttccttttttcatctactctctccttctcttttttcttaatcttgtcttattgtaccacatcaaagaaaactcttcagcaaaaaaagaaaaacccatagaacaaaaattctacaggttttccaaatttatacaaaatctatttttctactccctactgctttctctcttctctctgcacctgagcgtctgatacttgcaaaaatcgaaccggaaatattatgccatacactaaaaattgctcccggaagtgttgccagtggatttcctgcaaaatttgcagcagcaagtgacaccgcaagtccactgttctgcattcccacttcaattgcaatcgcagtcgttcttgagtattccacatgaaaaatctttgcgacaagaagtccaagcatcattccaaagaaattatgaattgccactacaacaagtacaagcactccacagcttaagattttctctgcatttaccgctacgattcctccaataatcattacaatagcgataacagaaataagcggcataacatcagacaccttatctacatgctcccctgcaagacttctcagtaaaattccaagcaataccggcacaagaataactttaatcacggacaataccattgcccagaaagaaacttctacccatgctcctgccagtacatagaccagaaatggtgtcataagcggtgctgccagagtggacacaatcgtcattcccacagaaagtgccacatctccccctgcaatataggtaatgacattgcttgctgttccgcccgggcagcagcccaccaaaattactcccaatgccaaatctgccggaagatgcatcactttgcaaagcacccatgcagccagtggcataatggtatactgcgctaccgcaccaataatcacttcttttggtctggaaaataccactttgaaatcattcatccgtatcgtaagacccattccaaacataatgacgcctaaaaatactgatgtataatttgtcatccatgcaaatccatcccgccagaaaaatgcaaggcaggaaaatgcaataataataattccaatatatctggatgcaaaactactgacttttccgattttatttaaaatatttttcatgcattatacctcgtagctgaagttgtcaatcaatctggtttttccaatatatactgccattgctacgagtacatttttgtcaattttttctaccggctgcattgtcagtgcatctacaacagaaacatagtcaatttttgaaagtggttctgcttcaattactgcacgcatctttccaagaagttcttctgccatcattcctgtctgaataatttcctgccctgcttttactgctcttgacaaacaaagagctgcttttctttcctctttacttaaataagtatttctggaagattttgcaagtccgtcctcttcacggataatcgggcagcccacaatttcaatgtcaaaatttaaatcttctaccattttgcggataattgccagctgctgtgcatctttctgtccgaaatatgccttgtccggtgctacgatatgaaataattttgacacaaccgtgcaaacacctttaaaatgaattggtctggtttttccacaaagggtttcagataatgtatcgatacttacaaaagcatgcgggtcatggtacatttccgatggttccggacagaaaatcatatctgcaccaaggctttcacaaagtttactgtcacgctcaaaatctcttgggtatgcctctaaatcttctgtcggtccaaactgggttggatttacaaaatctgatacaactacgatatcattttcttctctgcattttttaatcagacttgcatgtccctcatgaagaaatcccattgtcggaacaagtcccacggtctttccttcttttttccatgctttaatttgttttcttgtttcttctactgtttttgttacctgcatagtttgctcctctttcttcagttacatttcactgatgtcctgattttataaactcagagatagcctcttttctgaaattcactttcctcttacttgcaatactgttaatcctattgcttctgctgacttctcagccttactcttccatgtcttttaataagccatgtttctcataattggttactctactgattttattctcttcatttacaaatacaactgcaggtttatgtgtacgtgcctcttccggctcatactgtgcatatgccatgataataatcttatcacctgtacttacacatcttgctgctgctccattcagacagatcataccgctcccgcgttccccgcttatggtgtatgtctcgaatctgctgccattgtttacatctacaatctggactttttcatattccagtatgtttgcagcttcaagcagttcttcatccacagtaatacttcctacatagtccagttccgcctgaacaacggttgctctgtggatttttccttttaacatttctattgtcatcttatataatcctttcccataaggaaataaaaaaagcatttaaggacgcactccgaccccaaacacttctgattgatttcctgtatatccgagtcctgttttccttaaatacacaatacaggctcttatctttttatacttttgacatttacgtcataaattataaattctatataagattccagtgatttcagccagagtatagttttgagttcaaatactatctctggcgttattatcacatttaaagatttgtttgtcaagaggttcatttaggacgatagccccacaagtctacacagctagttgtaattccagaaaagccttctttaataataaaaatctcctgttcttctgattcatcaggagtatgttcagaatcagggttcatggaataagttggccagacttctttttttaagcaaaaaaatatgcgactaaaaaactatagttttcactataattctttaatcgcattccattcaccatacaatttattattttgttgttgtagagttttacaactctattatgattatgtacagataataccattttatttcatattagtcaattattctttatttatttattttttttgtgaacatttcacatttttctaattttacatttagcatttattacagatagctttagataaatttgaatgattatctccacactcctatcgttttttcaaaaaaatcttgaattgcctgctcatgttgtggatgaaaaatttcgggcagatttctttcgtcaaaaaatttcacctctacggtttcttcttgatctattttcacttctccgccaaccatctttcctctaaaaaaaatactacacatctgaatagtatcaccattttcgtatttatgaaaatatttgctgtaaactcctagcatatctataatagcaacatctactcctgtttcttcatgtacttctctgattgccgcctcttcagcagactctccgtaatctaacattcccccaggtattccccatttatttgaatctgatcttttttgcaataaaatttctcctgctttattctgtataattacacctgctgccattaacataattggcatgttccctactttatctcttaacattttccaatattccatacttgttctccttttatcttgcacaaataaaaagatgcgattaacaaacagtttcctcaactgtttttcttaatcgcatcttgtactcttcgcctaaaaatattttgttgttttttcttaacttaaattataacttcttatttaactgattgcaatattttcttttagaaaaagtcagggctttttttacgaaaactcagtttcagtattttattttttgaactaggtattttgcccaatcaaccttttttagttacaacacactaataatctacattttcggctgatatctcatattcgatacattatataccgtcacaaatgcttttggatcttctcgattaataaagttcatcaatttttgatattctgtcttatctacaattgtgataatttcatttcttttttgcatcttatatgcaccggtcgcctcgtagatagttgctccactatgcaaatcttcaataataaatctacgtaactcttcttctttgtttgtaatcacacaaactcgacgcttgatattatgatcaaagataaaatgatctaacaccattccattaaaataagttcccagaatacttaaaactactgtttttttatcatacactaacgcagctgaaagtgctacgcacattccggataaagacattgcccttccaagttccatattcagatacttattcataatttttgctacaatatcaagtccaccggaagaggcatttcgattaaataaaatgctaagtcctatgcttaccactaaaatataacaaaggacatctaattcctgactattggtcatcgaaccgaaatttggcgcaattttttcaaacaagccaataaacagcggtaagacaacactggtataaaccgtctttgctccaaattctcgaccacaagtgaaaaagccaattatcaagagcactacatttaaaatcattgtaatggcagataacggcaatggcacaaagtttgatattacaattccaagaccggaaatactactcactgaggtgtgacttggcactaaaaagaaataaaccgctgctgcaataatggcaactgcccaggttaaaatgatgatttcttttataaaatttttgtaatttaatttttctttcatagcttctttgttcctccaataatcaaaactcgaatcctcaaaataatacccaacagaaaaaccccggaaaccttatggttccggagtatcttacgtttgggcacaacattatcttgcgataacagatctatattcagtagtcgactaaactcaaactgcgtcttatgacttgctttcgttaagttctctgcctaattactcgatgattatagcaacacgacctgctcctacaatacgtccaccttcacgtttgtgaggttcttaaaatctcattattttctgtgattttcgtgtctttattgtcctgtgttataggatttctacgctatatttctgttctcttcattttttagtatcaaaacggtatcacagccagattttcatgagctgtcaactttccggttgcagattcccaccttgactgttataatcgaaacatgggtgctatcataacggtaggcggttagtccttcagcagagggactgtgaccctctgattacatagaaactcgaaagagaatccactggaaaggagggctaagccaatgagtattgtggactttattgcagtcgtgagcttcggcatcacctgcttttgtgccggatacacattcggcaaagataataacaagacacaaaaataaccgccccagcctcgcaaactgaacggttatttttaatcaattaagtatgtggactaaccgtctatcggtagcactctttttctataatcatattagcacgcatgtgtgaaaatgtcaaaaaatttcttcattcttggttattaatctccttgatcaactgtactgccttctctgcatcatcggttttcacgaatatatccacaccatatattccaaatcctggtgccccatgcattgcaacattcgcacctgcttcctgcgaaaaagctgctattccattttgctttaacatttctacaagttgttctgtctctactatattctgtgcattataaatttttgtccattctgccttagatatggaagtttcctttttctcctgaatatttgacgaattctggtttctttttcgattaataaatgccaagagcctaagaacaataaatgccacaatagtaataccaatcagaaatcccaatgctaattgtgttacctgtgtttctgtagctcccattctaaataaacatatgccatagatgactgtaaaaattcctgtacatatcacactggtgagaaaatctcgccatatagtagcactttttggcaaacatttatcccatattccattatacaccataatagaggcgtacaggattcctcctaccaaagcagttgctgtctctcctaaaaccaagcgaatatccacagttaataacatctgaataataatcgctaacacgctaatcacaaacattgatgcaaatgcaagatttccagcctttaatgctttttgtttcacccatccttcatacaccacaactttgtccagtgtttctttcatctctttattcatagtctggctcctttctccatccaggagctctctcatctcaacatcgtaatattcagcaagttgaacaagtatactgagatctggcatatttattcctgtttcccatctggaaactgttcttgcagatacctcaaacttctcggcaagctgctcttgcgtaagattcttttctttacgacattgctttaaaaaagctccaatcttttttgtgtccatgtctctacctctcttccacttacagcttaccaatatgtatcaaaattaccacgacataaaacgagaatccgctaattttcaaccggacatcgtatgtctaaaacaaataaacggtattttcaccccaaaagcattctattcctctataaattaaccttctcttttatgtctatccataagtagcagaataaacataacaaaccatatcacccatgcaattaaacaaccgattcctatatgccaaatatctataatcattccagcaataaaaggaattgacataaacatcattctcttcccatatgccttacacatagcattttcatcatatttttttcgttcttctgctgatttcatattataaccagacaagaatttggatgcttgtccttttgacctataaaaccatattccaaataaaagcataatcactgccattgcaaagtcaaaaataatataaatatagaacatataatgccttcctttcagtcaattcctcaaaccagaaattattactttttgcatagtgtgttttctaaaatgataataaccacgacatcaactacaatgattcccaatgcaatatatacaaaaaatgcaggcaaaatattttcaagcaagcccataattaatacaagaattgctataatagacattccaactcccattgtcctgcataacttcttttcatcatattttttcttttcttcttttgaagctgtattatatccagaaataaaccagcttccgtgtccagaaagtaaaactatagaaagtacagcaaatattacaaagacaatccacactatccaatcagaacctgttgctaaatctgctaatttcaattatagacccctccctaaattccgtttttcttaattctaaaaatctgaaagttgtcttttaagatttcaatttcgttaaatcctctaaatacatttctgtataaccacattctgggcagactgcaactctaacatcatctatagttgtcgccttttgtttttcatctacacgaacaaccatcccatagccaccgccattaactttaagtcttaaatctaatttcatacttgctccacacttttcacatttcctcattgtttatacctccaaatcccgaatttgagaaaaagcccaaaggacttttaatgtcccttatgcttttctcttttctttcgctgttttagttcaaacattcgctgttcttccgcctcttttttctttcgttttttttctttacgctcctgtttgttctgttcctgttgtaatttcaacgcctgttgcgattttgtgccaatgccagtttccagcatctgcttttttgctgaacgctgcatccgtttcggatttctttttatatcctttacaatagcttcaacagccggactgaatttcaaaccgaaatagtatttttgaatatattcctgcacttcataatcttttggttctacgccaaatgttacctttgccacagataatttaccatcttcaatatgctcaaatatgcctacccaaaatggttcttcaaaatataccgtcaatcttccatttactctgtccataaaaatccctcctaaaatttattgaacaaagaatggacaacccggaggggcaggttacttaccctatttatataggacggccgggctacctaccggctctggcacatcaaagatgcacgttgcgtttttatctttgttttgataagtttcaatttaccttcactttattttaccatagtgctttctaaagttctattctaatatacaaaaatgtaaaaaagcgattttatccccctcgcaatcacacatatatcatgtttttcaatacaatttcttctgcactagcttttatattattcatcagcctgacccactccatctgatcctgtgcctttaattcttcagttacaccctgtttttctgtcatctgttccataagcgtttccacctgttctctagcttcctgatcagtctgattcagatgttcattcagctttccaatcaataacaaatactgataccttgctgatctgtgttcttttaagaactgctttcgtaacattccatattttccatatgtcggctcttcttctcttaaaaccagatccggcaaatagtaatctccatgcaatgtatagctcattccatttttttcatcataaaattgttttttcatagtctaaatctccaatcctttgtattttgttctatttttcttacgttgttggttttcaatctgactcttttgagtcgcccattccaactgtttcagaacgcttccctttggcatttgctccattcgccgtttttcttccagtgtcctctgttctttaatatcctgctgcaccacatcctctacagtttctgatcccaaaatacgcaccactctgtcatatctgtccgaaatctcttgtaaacgttgattatcatttaataattccccattttctttacgcacatcatctaactgcgtttggatatcatcacatttctccgtagatttttgatatttgtttttccagctttctatcgttttgttaagttctacaacctttccagctaatgcagcaatctgattcttcatcttgataaacaatggcttgattttattttctctgtaaggtactgcacgttcaaatgttcctgcctccggtaaaaacgtcttaatcattccatattcttttatttctttactggcattatccataatcggctgcagcacatctcgacgctcttccagactttttacttctttttctgcgtcctctgccctttgttctgcttcttgtttctccctgattgcctgttccttatcgtcttttaaaatctggatatctgctctgaattccgcaatttgtgctgtcagttcttcgttttctgcagttagatactctttctcctgctccagctcctgtacttccttttttcgctctttcttcttgaagttataaacatccaaatgttcctcatgagtacctttctgttcccattcaatgccatgctgttttgcaatctctgccaggacctttttttcatggttcatccactggttcaactctgtatcatgcttatttccaccttgaaatccaagactttttaatgcctgtttcaatgaaactctggtgtccattccttttcctttccaatcagtcacataaggaataaaatcaatatgtaaatgtggagtagactcatcctgatgtagataacacccaaatacccgtagcgctggattccgtttctggaagtcctttacatattcatccagcacttttacagccagatctccttctactgttccgacagccatatcttcacgatttccaatctggaaaatcacttcgtggaacagcttttcctgctttccctgacggattttttcatagtaatttataatctgccgatcctttctttttcccacattataccgttctacagaatcatcaaacaactctttatatacttctttcagattttcattctggtaacggatattcaggtgtactctgtccggatctacattttcagctataaaatcccgtctgttatgagctagggaaccagctccaatcatgccgcttattgtcctttttattgtcatattccttcacctccccttctaaaagcagtgccagatattgcatataatctttatttacgccagccatggcaattataagaaatcttcgccggatacggcggttttgttacttttgtcaaaagtaacgcaaaagcactttcgacagccgtaccgtccatcaaaagtaaccttgcgccctgccgggggctatttctcctgcggtatgtatccgcatatcctattccggtattctcgcccggatatattccagatcaccacagtacggtgttcctaccagataccattcccttgccggattcatctccattctggtctgcacccactgatcatcaattagtacttccaggcattctccacaatgaaatcctgtatcaatccataaatctgatgacaataaaccatatctgtcgttactgctgttataacctaatcttccttctctcattgctgtatgctcctttctattgtcctgctgtaagcacgctctgctttagggctccctttcgcaacctataatttgtctataaataatcgggtaatctataacctctcgtctgcacattacagactttcccttgtctgatatttacaggtgcgtgacacgctcctgttatagagtaatcaacaagaagttttaccatcgaaagctttccggtattccctttttttccagatattcctgccggtacttttctctttcttcctctgttgctgctgttttgtacttgctgtataattctcgatttatcattgtatccagctttttttccaatcctttttttatatcatcctcttcctgtttctgatccagtaaatgatattttaaaagttttccaaacaactcctctggaaccataacgtttttcattttctcaccttcttacttttcagataaggacgcaacactgcaatgtctttacagattgcaaccttgcattttaattccgcattttctatatactctgcaatgttgcacccttaatttattccggcttaactttatttaaatcccaataccaggaattaccgattcgtcttgccttaattccaagttccttttttgcattttccagtgttcttttagaaatattcaaatcttctgccatatcaaagatttcactgctttgcacagaagttgatgtttctgccagttccctcagcatcttttttgcctgttccagtttatttacctttggagcaattccaccaagcacctcatctgctgtgatttcatagtcacctatccactcaaatccggtttctgtcaggcgaaatgctttggaatgtccaaatgcagccagattatttttaatctgaaccactgctcttaagtccggttctccctctattcttcctaccagtaatacgcttctggctactgcaaaaaagtcaatcgaacccattcctctatatgcagctttatttccaccagctttattcatatgtccgattaataaaattgcacatttatacttttctgccagcaagctcaatctttttgtcatatcccttgcttcatttgcccggttcatatccattgttcctccaaggtatgcctgaatcggatctaaaataagcactctcgcaccagtccgtttgatagcagtttccagtctctcatctatcatggaaagtgatttttctgtttcatctataaccatgattctttcacagaccgcttctgccagctccagtctgggttttaccgtatctgccagcccatcttccgctgtctgataaataatctttactggttctgttactttcatatcgttatccagaccttctcctttagacaatctcgctgcaatatttaatatcagcgtagtttttccatcgcccggatcaccctgaatgatcgttaatttcccataagggataaatggataccagagccagtccactgtctgggactggacatctgacatctttatcattttcaattctgttttattctcatttctctgttccataaattcctccatttttcaaactattctcgccaattatctgttgttctctggaagaatccctgatataatcaacttgtctagggttgacatttgtggattcgtccccatttgtcacattgctccggttgttcgtacttccggagctttttatattttcatcatccagcatatctgccaccactttctgctgatctggatataagtgcccataagtattcaatgtaatgcgaatgtccgtatgtccaaacctttctttaatcatcaatggttgcactcccttattgatcagaaatgccgcatgactgtgacgaatgtcgtgtactcttatcttttttactccggtcttttgaaccacctgttttaacttatgctgtaccgcttcatgaaccattggaaaaatccgttcatcttcgggcaactcatacagtctgctaatatagtcctgaatctcttttttcagaaattccggtatggaaatcgtacggttcgattcttctgttttgggagatgtaatcacgtcctctccatgcatacggtagtaagttttattgatatgaagtagattcttttcaaaatcaatgtcagcaggtgtaatgctgagtgcttcgccttctctcgctcctgtccagaataataattcaaacagcacataatatttgcttcccggttctattccggtcataaactgccgatattcttcaattgtccaaaacttcattttcttttttgaagtctttcccatacgttttactttgtcacaaggattatctgccagattgtagatattcttcgcatgattaaacaatgccgtcatctgattctgtattgttttcagataatcatctgaatatcctttttcaataatcgtattctgccactggataatctctgctggtgtgatactgttcatcggtctgtccttaaaatacggtaacagttgagcattcatcgtatctcttttgttcttgatactcctgtccttcaatgactgagacttgtctcggaagtagacttctacaaactctcccattgtcatatccatgtctgctttcgctgttcttttatactccgcttcaaaatttaatgcttctttcttagtgcggaatcctctttttacttttcgctttttggctcctgtccagtcctcataataaaatgaaacataccaggttcctctttcttcatctttgtatgctgccatactttctcacccccttacattgcaatctgggaatatccataaaatttcttttcccagaatgccctcggtatcttgcccgcaacggttacatatccctgatctgcaagctctttgttcagtttgcgaagcagcttgtaagcatatccaagtgaaatccccatgctctctgcaacttcttccgctgtaatcatatagttctgtctctgcatatcatttcctccttgtctataattatcattttcactgatactatatcattttaaataatcattgtcaataatttttatcatcatgaatgatatttttctatattgttgatttttatcatttgtgatatactaatcatagcttttaaggaggtggataatatgcaggaatcatctatttcagaaaaaataaaagagctgcgaactgatctgaagatgaatcaaaaaaacttttccgcagctattggtatacgtcagtcaactttatccagttatgaaaatggtgtggttactccctccaatgatgtgttattgactattgctcagaaatttcatgtctcactggactggttatttggattatctgaaaataaagtacagatttctactctcagcgatattctttgggttttactgcagatgaatgaatccaatgaactccggtatgaactggatataaataataaacttcccggtgatatagaaacagaaacacagaaatggtatgccggacttcgcttttatggaaatgatcctgaacattctttaaacgcagatatgtgtaattttcttgctgatctgcaggagaacagagaaagcctggaatcttatttcacaggcaaagatatgtttgatatgtggaaaaagcagacgttggaatactacacttccaaacctgtcacccataaagaaattgaagaactggattttgagacacgaatccgtaaacgagatgaacttttaacacagaaattttccaataacgaacagaaatagtatcataacagtatcacaggcagatatgcgaagattttcattttcttcccatacctgcctgtttttaatttattcgctattctttacagccttattttaaactttttactcaacagaaaaaccccggaaaccttacggttccggggtatcttacgtttggacacatgtaccttgcggtactcaatatatattagtcagtgattactcgatgattgtagcaacacgtcctgatcctacagtacgtccaccttcacggatagcgaatgtaagaccctggctcatagcgattgggtgaatcagttcgattgtcatttctacgttatcaccaggcatgcacatttctgtaccttctggtaagttacaaacacctgttacgtctgttgttctgaagtagaactgtggacgatagttgttgaagaacggtgtatgacgaccaccttcatcttttgtcagaacgtaaacctgagctgtgaattttgtatggcatgtgattgttcctggtttagcaagaacctgtcctctttcgatttcgtttctctgaacaccacgaagaagtgcaccgatgttatcaccagcctgagcttcgtctaacagtttacggaacatttcgataccagttacaacaactttacgtgtttcttctttcagaccaacgatttcaacttcttcagatacgtgaagaacaccagcttctactctaccagtagcaactgtaccacgacctgtgatagagaatacgtcttctacaggcatgatgaatggtttgtctgtgtcacgctgtgggtctggaatgtagctatctacagcatccataagttccatgattttgtcgccccattcgcttgctggatcttccagagctttcagagcagaacctttgatgattggagtatcatcgcctgggaaatcatattcgtctaacagttcacgaacttccatttctaccagttcaagaagttcttcgtcatcaaccatatcacatttgttcaggaatacaacgatgtaaggaacacctacctgacgagacagaaggatatgttcttttgtctgagccataacaccatcagttgcagctacaactaagatagcaccatccatctgagcagcacctgtgatcatgtttttaacgtaatcggcatgtcctgggcagtcaacgtgtgcatagtgacgatgttctgtttcatattcaacgtgtgctgtagaaattgtgataccacgttctctttcttctggagctttatcaatgttctcgaaatctgtagctgagttaccagcaactctttcagccagaacttttgtgattgcagctgttaatgttgttttaccatggtcaacgtgtccgatggtaccaatgttacaatgcggtttgcttctttcaaatttagcttttgccattttgaatgtcctccttgtttatgcgccccgtacgggcaatttttgtttgcttactgcctcattacgagacgtcggaatataccaatattatattaaaatatattcaacctgctatccttgattatattgcaaatcaaggatatttgcaagtttttttatcaataaatacgactgattattttgtagctttaccagcgagtactttttcctgtacggattttggtactggctcgtatttttcaaagaacatggagtagttaccacgaccctgtgttctggaacgcaggtctgttgcatatccgaacatttcggaaagcggaacatatccacgaatcattttaccaccgccgatatcgtccataccttcgatacgtccacgacgagagttaatatcaccaataacatcacccatgtaatcttccggtgttgttacttcgactttcatgattggctcaagaagcactggtgctgctttctgcatagcatctttgaatgctaaagaaccagcaatgtggaatgccatttcagaggagtcgacttcatggtaagaaccatcgtatacatttgcatgtacaccaacaactgggaatcctccaaggataccagctttcatagcttcttcgataccttcgcctactgccgggatgtattccttcggaatagcaccaccaacaactgtggattcaaacttgtacagttcttcaccgttggcatccataggctcgaatttaactttacagtgaccgtactgaccacgtccaccggactgttttgcatatttgctgtcaacgtcaactgcttttgtgatggtttctttgtaagcaacctgaggagcaccaacgttagcttctactttgaattcacgaagcagacggtcaacgatgatatccagatgaagctcacccataccagcgataattgtctgaccagtttcctgatctgtatgagcacggaatgtcgggtcttcttcagcaagttttactaaagcttcacccagtttaccctgaccagcttttgtcttaggctcgatagcaagctcgataactggttctgggaattccatggattccaggattaccggatgctgttcatcacagattgtatcacctgttgttgtgtttttgaaaccaacagcagctgcgatatcacctgaataaactttatcaagttcctgtctcttgttagcgtgcatctgaaggatacgaccaacacgctcttttttaccttttgtagcgttcagtacgtaagaaccggagttcattgtacctgaatatacacggaagaatgcaagcttaccaacgaatgggtcagccataatcttgaatgctaaagctgagaatggttcttcatcagaagaatgtctctcaatttcatttccgtccatatcaacacccttgatagccgggatgtctgtaggagctggcatgaattcaagaattgcatccagtaatttctgaacacctttgtttctgtatgcagaaccacagcaaaccggaacagctgcacattcacatgtaccttttctcagagctgcttttaatgcatcgatagaaggttcttcaccttcaaggtattccatcattaaatcatcgtctaattcacagattttttcgatgagttctgtatgatacagttctgcatcttcctgcatatcttcaggaatgtctgtgattgtgatatcctcacccttatcatcattgtagatgtaagctttcatttcgaataagtcgatgattcctttgaactcgtcttctttaccgattggtaactgaaggcaaattgcgtttttacctaaacgagtcttaatctgatctactgcattgtagaagtttgcacctaagatatccatcttattgatgaatgccatacgtggtacattgtaggtatctgcctgacgccatacattttcagactgaggctcaacgccgccttttgcacagaatacaccaactgcaccgtcaagtacacgtaaggaacgttcaacttctactgtgaagtctacgtgtcctggagtatcaatgatattgatacgatgttccagtgcacctggttttgctttacagttttcctgtaaagtccagtgacaagttgttgcggctgaagtaattgtgatacctctttcctgttcctgttccatccagtccatggtagcagtaccttcatgagtatcaccgattttatagttaacaccggtatagtataagatacgctctgtaagagtagtcttaccggcatcgatatgtgccataataccaatgtttctggttctctctaacggatattctcttccagccaatggattttcctcctattgaattagaatcgatagtgagcaaatgctttatttgcctcagccatcttatgcatgtcttctttcttcttaacagatgcgcctgtattgttcattgcatctaataattcatttgccagtctgtcttccattgttttctctcctcttttacgagagtagagagtaatccagcgaagagctaaagcctgacgtctttccggtctaacctcgattggtacctgatatgttgcaccaccgatacgtcttgcttttacttccagaacaggcataatgttgttcattgcttcttcgaatacttcgattgccggttttccggctttttcctcacatttagcgaatgcaccgtatacgattttctgagcaacacctttcttaccatctaacataatgttattgataagttttgttaccactttgtttccgtataacgggtcagctaaaacgtctcttttctgagtatgtcctttacgtggcacgttacttccctccttaatcattttcattgttaatagacaaatgacattgtcccaaagattaaatcatcggtactcacacaactataagcgtatgtccgtacgcggtaaattctctatataaacccgcagccactccgttgggcttatggaatccccgtacaaaatcaatagttatatctgtgatttcaaatgataatttctactataataaatcaagcggaaatttttaccgcctggccgaatttattattttttcggtcttttagcaccgtatttagaacgggcctgacgtctgtttgcaacgcctgcggtatctaatgtaccacggatgatgtggtatcttgtacctggtaagtcttttactctaccaccacggataagaacaacgctatgttcctgtaagttatgtccttcacctgggatatagcttgttacctcgattccgtttgagagacgaactctggcgatttttctaagagcagagttcggttttttaggtgtagcagttttaaccgctgtacacacacctcttttctgtggagaagacatatctgttgtcttcttctgtaaagagttgaagctcttctgcagtgccggagctgtagactttttaacggaagtctgacgtccttttcttactaactgattgaatgttggcattcctttcacctcctgtattatttttcttctgccatattatatagaagaaataagtggctgccagttattcattcttatgaataaactttttttatcgcgcacaaaaaatacgcagtcctgtgcacgcctcctcattatatctgtggaaaaagttgctgtcaaggtatttttttgttttttttatttttctttcaaaaatccgaccctcacactcatttatccgtctatgaaagagaaaaacaaaagactattttgccagttatctgacaaaacagtcttttgcatttattttcttactactcttactcttctgttaattctgcttcttcttcctcttcggaaagttctacttcatcaacagcatctgtaagtgtttcttctgtatcctctgtggtttcctcaccaactgttacgtcttcattttcttccatttcgtcaaactcaacttcttcttcatcagtatcaagcttaatattggaatactgtttcatacctgtaccagccggaatcagtttaccaatgataacattttctttcagaccaatcaacgggtcaatcttacctttgattgctgcttctgtcagaacttttgttgtttcctggaaggaagctgctgacaggaaggagtttgtagcaagagatgcttttgtaataccaagcataacctgttttccttctgccggttctttgccttcttcaatcagtctttcgttctcttcttcaaagtcaagaacgtcaactaatgttcccggaaggaattctgtatctccgttatcttcgatacgaatcttcttcagcatctgacgaacgataacttcgatatgtttatcattgatttctacaccctgcagacgatatactcgctgtacttcctgaatcatgtaatcctgaacggcacgtactcctttaatcttcagaatatcatgtggatttacagaaccttctgtcagttcatcacctgcttcaagtacctgtccatcctgaatcttaatacgggagccataaggaatcaggtaagtcttggagtttccatcttcgttgtctgtaacaatgatttcacgtttcttcttggtatctttaatggtagcaatacctttgatttctgtgataatcgcaagaccttttggctttcttgcttcaaaaagctcctcgacacgaggaagaccctgtgtaatatctccaccggcaacaccaccgttatggaaggtacgcatggtcagctgtgtaccaggttcaccgatagactgagcagcaatgatacctacagattcaccaacctgtactgcttcacctgttgccatgtttgcaccatagcattttgcgcagacaccaatatgacatttacaggtaagaatggtacggatttttactgcatcgtagccagttccatctgcttttacaccgtcatttacgattcttgcagcacgttttggtgtaatcatatgatttgcttttacgattacttcaccatttttatctttaattgtctcacaggagaaacgacctgtgatacgttcctgaagactttcgatttcttctcttccatccatgaaggcttttacccacatacccggaatttcgtttctgttttcactacagtcaacttcacgaacgattaagtcctgagaaacatctaccagacgtcttgtcaggtaaccggaatcggctgtacgaagagcagtatcggacataccttttcgagccccatgcgctgacatgaagtattccagtacatcaagaccttcacggaagtttgatttgataggcaactcgattgtatgaccggttgtatcagccatcagaccacgcataccggcaagctgtttaatctgcttgtcagaaccacgggctccggagtcagccatcataaagatgttgttgtacttatccagaccggacagcagtacacgtgtcagctcatcatcggtctttttccatgtttcaacaacttctttgtatctttcttcttctgtgataagaccacgtttgaagttctttgtaattaagtctacggtatcctgtgctttctgaatcatttccggtttctgaggcggcacagtcatatcagaaattgatacggtcatcgcagctcttgttgaatatttataaccggttgctttaatcttatccagcacttctgctgttcttgtagcaccgtgtgtattgataactttttcaagaatctgttttaactgtttcttacctaccaggaagtcaacttccggttttaattcatttcccggaattgtacggtctacaaaacctaaatcctgaggaatgatttcattaaataagaaacgtccaagtgtagattctactgtaccggaaagaacagttccatccggcattgttttttccatgtgtacatggatttttgtctgaagcgtaataacctggttttcataagccagaattgcttcgtttacgctcttgaagtattttccttctcccttaacaccaggtctttcctgtgtcagataataaataccaagaaccatatcctgtgaaggaacggctaccggaccaccatcggatggttttaacaggttgtttggtgagagaagcaggaaacggcactctgcctgtgcttcaacggacagtggaagatgaaccgccatctggtcaccatcgaaatcggcgttgaatgcagtacaaacaagcggatgtagcttgatagccttaccttctacaaggattggctcgaatgcctgaataccaagacggtgcagtgtaggggcacggtttaacataaccggatgctctttaattacttcttcgagaacgtcccatacttccgggtcgagtttctctaccatctttttcgcatttttaatattatgtgcatttccgttgcttaccagttctttcataacgaaaggtttaaacagctcgattgccatttcttttggcagaccacactgataaatcttcagttccggtcctacaacgataactgaacgtcctgagtagtcaacacgtttacccagaaggttctgacggaaacgtcctgatttacctttgagcatatcagaaagggatttcaatgctctgtttccaggtcctgttaccggacgaccacgacgtccattatcaatcagagcatcgactgcttcctgtaacattctcttttcattacgaacgataatgtcaggagctccgagttcaagcagtcttttcagacggttattacggttgataattcttctgtacaggtcatttaaatcagatgttgcaaaacgtccgccgtcaagctgaaccattggacgtaagtctggcggaataaccggaacaactgtcataatcatccattccggacgatttcctgattctttaaatgcttctacaacttcaagacgttttacgatacgtgcacgtttctgacctgttgaatcttttaaacctgcttttaattctgctgattctttttcaaggtcaattgcttcaagcagttctttgatggattctgcacccatacctacacggaatgcagaataaccatattttgcacaagcttcctgatactctttttctgtcagtatctgtttatactgaagctctgtttttcctgcatcaagaacgatgtagcttgcaaaatacagaactttttccagagaccttggtgaaaggtcaagaatcagccccattctggatgggattcccttgaagtaccagatatgggataccggagctgcaagctcgatatgtcccatacgttcacgacgtacacttgcttttgtaacttcaacgccgcatcggtcacaaacaacgcctttatagcgaattttcttatatttaccgcaatgacattcccagtctttgcttggtccaaagattttctcgcagaaaagaccgtctttttccggtttcaaggttctataattaatagtttccggttttttaacctcgcctcttgaccattcccgaattttttcaggggatgccaaaccgattttaatagcatcaaaggtcattggctggtatacctctttatttgctgtttctggcattgtggactcctttccttactcttccagagtatcctcatctacgctcagtaaatcatcgtcattgtcttcttcttccacatcgactaattcttcaccttcaaattcctgtttctggaatccgtagttgccgtaatcttcgtcatctctgtggtgtctggaatcaccttcgataatagaacgcatatcagtctcgccataatcgatattttccatgatttccacttctgtcatatcatcttttaagactctgacatccagacccaaggactgtaattctttgagaagtactttgaatgattccggaataccaggctccggaatattctcgcccttaataatcgcttcataagtcttaacacgtccgattacatcatcggattttacagtcagaatttcctgcagagtataggaagcaccataagcttcaagtgcccaaacctccatctctccgaaacgctgaccaccaaactgagctttaccacccagcggctgctgtgttaccagtgagtatggaccggtagaacgtgcatgaatcttatcgtctaccaggtgatgcagtttcaggtaatgcatgtgtccgattgttacagggctgtcgaagtattcacctgtacgaccgtcacgaagtcttactttaccatcactggaaatcggaacacctttccacagttttctgtgttctctgttgtctgacagatactgcattacttccggatttaatgtatctttatgttttgcctcaaactcatcccattccatgtttacatagtcatttgcaagtctgagggtatcctgaatatcaacctcgtttgcaccgtcgaataccggtgttgcaatgttaaatccaagtgcttttgccgcaagacttaaatgaatctcgaggacctgtccgatattcattcgggaaggtacacccagaggattcagtacgatatccagcggacgaccgtttggtaagaatggcatatcttctacaggaaggacacgggaaacaacacccttgttaccgtgacgtccggccatcttatcaccaacggaaatttttctcttctgagcaatataaatacgtactgcctgatttacaccaggagacagttcgtcaccattttctcttgtaaatacttttgcatctacgataataccgtattcaccatgcggtacttttaaggaagtatcacgaacttcacgtgctttttcaccgaaaatcgcacgaagcagcctttcttctgctgtcagttctgtttctccttttggagttactttaccaacaagaatatctccggcacgtacttctgcaccgatacggatgataccacgttcatccaaatcttttaatgcatcatcaccaacgcctggaacgtctcttgtgatttcttccggtccgagttttgtatctctggcttctgcttcatattcttcgatatgaacagaagtataaacgtcatcctgaaccagtctttcactaagcagaacggcatcctcgtagttataaccttcccaggtcatgaatccgattaatggattcttacctaatgcaagttcaccatttgatgtagaagggccatctgcaataacctgtccggcttctactctctcacctttgaacacaatcggtctctggttgtaacagttactctggttactacgcataaattttgtcagatgataaacgtctttctttccatcatctgtacggataatgatttctttggaagctgcacactctacaacaccggaattttttgcaacaacgcagacaccggagtcaactgctgcttttgcttccataccggtacctactacaggagcttctgttgtaagaagcggaacggcctgacgctgcatgttggaacccatcagcgcacggttcgcatcatcgttctgtaagaacggaatcagcgctgtagcaacggagaataccatcttaggagatacgtccatgtaatcaaacatatggcgttcatattcctgagtttcttctctgtaacgaccggatacgtttttatgaatgaaatgaccctctgcatccaacggctcattcgcctgtgctacatggtaattatcttcttcgtcagctgtcatataaacaacttcatctgtaacacgaggatttttcggatcagatttatcgattttacgatatggagcctcaacgaatccataattattaattcttgcataagatgcaagggagttaatcagaccgatgttcggaccttcaggggtttcaatcgggcacattcttccataatgagaatagtgaacgtctcgaacctcgaaacctgcacggtcacgggacagaccaccaggaccaagtgcggataaacgtctcttatgagttaactcaccaagagggttgttctgatccatgaactgtgacagctgggaagaaccgaaaaattctttcactgctgcagttaccggtttgatattgattaaggactgcggagaaattgtatcgctgtcctgtgttgtcattctttcacgaacgactctttccagtctggaaagaccgattctgtactggttctgaagtaattcaccaactgcacggatacgtctgtttcctaagtggtcaatatcatcatcatttcccagaccatattccagatgcatattgtagttgatagaagcaaaaatgtcttcttttgtaatatgcttcggaattaattcatgaatatcacggcggattgcttctttgatatcttcaatgtcttcattttcttccagaatcttagccagtaccggatagtaaaccatctcggaaacaccaacttcttccgggtcaatatcaacaaagcttgtgaggtctaccatcatactggacagtactttgattttacgctcttcgccctgaatccatacgaaaggaacagctgcattctgaatctggtcagccagtgcttttgttacaactgtacctgtttctgcaataatttcacctgttgtgacatctacaacttcttcagccagcggatgccctacaatacggtttcttaataacagttttttgttaaatttataacgacctacttttgccaggtcataacgtcttgcgtcaaagaacatgccattaatcagactctctgcgctgtctactgcaagcggttcacctggacgaattttcttatacagttctaaaagacctgtatgataatcctcagatgtatctttaccaaaacttgcaagaatctttggttcttcaccgaataaatctataatttctgcatttgtacctacacctaaagcacgaatgagaactgtaatcgggacttttcttgttctgtctacacgaacatagaacacgtcattggaatccgtctcatattccagccatgcacccctgttcggaataactgtagcagaatacaaggtcttacccagtttatcatgagcgattgcgtagtagatgcctggagaacgaaccaactggctgacaattactcgttcagcaccgttaattacaaacgttcctgtagcagtcatcagtggtaaatcacccataaaaatctcgtgttcactgacttcgtcattttctttgttgtataatcttacctttacttttaaaggtgcagcataagtcgcatctctttctttacactcttcgatggagtattttacttcatcttcgcataaagtaaagtcaacaaattccaagcttaacttaccgctataatctgcgattggagagatatcttcaaaaacttcattaagaccttcgtccaaaaaccactgataagagtctttctgaacttcaatcagattcggcatttccagtacctctttctggcgctggtaagtcattctcatgctcttaccggatttaatgggacggattctgtttttctccattgacgtttcaccccttgtatgttttaattttattatggattatgattcagatcctgttttcttcctgtaaatttataaataaatagaataacaggcataagtttccataatagtgcatttttcactttatcacattctataatgcatgtcaagcattttttcaactaaattttttcattaaaatttttcattcttggataaacaaaaccccgacatccaaagatgtcggggtcaaaagttctggcaagtttacacttaaattatttaagagtaactttagcgccttcgccttcaagttttgttttgatttcttcagcttctgctttagatgcgccttctttaacaactttaggagctccgtcaacaacttctttcgcttcttttaagcctaatccagttacttcacgaactactttgataactttaactttgttaggaccaacttctgtcagttctacgtcaaattcatctttttcttctgctgcgcctgctgcatctcctgctgctgcaactacaacacctgctgctgcggatacaccgaattcttcttcacaagcttttactaattcgtttaattctaatacagataattctttgatagcttcaataaattctgctgttgttaattttgccattttaaatttacctccattttttcgtttttcaattttagagtaccggataaccggtcatatttcttattttctaccgcacattattctgctgctgcgccaccctgctgttcagcaatctggttaagcacacgagcgaagtttgtaatcggagactggatacttccaagcaattttccaagaagttcttctcttgatggtacttttgcaagagcttcgattccagctttatcatagtaagtgtcttcaacaacacctgctactaattccagagtcggaacgtcttttgcatatttagcaagaattcttgccggtgcagttgcgtcttctgcgcatactgctaatgcatttgttccttctaagtgctggcataattcttcacaaggagttcctttgaatgcaaagttcatcattgtgtttttgtatactttataagtaacaccagcttctcttaattccttacgcatctttgtatcctgttcaacagtgatacctttgtagctaactaatactacgcttgctgcaccattgatgctgttagcgatttcttctacgacaggctttttaagttctacttttgccatgaattagtgcacctccttatttttttaggctgcgctgctcctttacgaaaggtacttcaatattagtacttacaaaaagacctctccgcacaagacagagaggttttatcaatcctaaactttgtaagaatgaatctttcctcggcaggcgttttaaccttatgcctaacggcacctgctgtcttcggcagctattcctctagcagaataccaaacctatagaggtttgtcaagaactttttttatttttttattttacaacacaaaaaagacgccatatctctcttgcttagatacgacgtctttttctaaaatctattactgagctaattttaccgggttaaccttaacacttggtcccattgtagaagcaagtgttacactcttcaggtactgacctttcagtgtgcttggtttagcctttgcaatagctcccataagagtctggaagttgtctgctaactgctcctctgtgaaagaagcttttccgattggcacgtgaatgatgtttgttttatcaagacgatattcaatcttaccagctttgatttcctgaacagcttttgttacgtccattgttactgtaccagcttttgggtttggcattaagccttttggtccaagtacacgacccagacgaccaacaacacccatcatatccggtgtagctactactacgtcgaaatctaaccatccttcgttctggatcttcggaattaattcttcagctcctacgaagtctgctcctgctgcctgtgcttcatcagcttttgcatttttagcaaatactaatacacgaacagttttacctgttccgtgaggaagtacaactgcaccacgaatctgctggtcagcatgacgtccgtcacatcctgttctgatatgcgcttcgattgtttcgtcaaatttagctaccgctgttttcttaactaaagagatagcttcttctgtttcatataaatttgcgcgatccactgcttttgcagcttctacatatttctttccgcgtttcatattaataacctcctagtggtaattgcgggaatgtccctcccacgttcgtttgatagttaattactcttctacagtgattcccatacttcttgcagtaccagcgatcatgctcatagctgcttcaagagaacctgcatttaagtctggcattttcatttctgcaatttcctggatttttgctttggaaattgtagcaacttttgttttgttaggaacgcctgaaccagatttgatgttacaagctttctttaacagaactgctgccggcggagtctttgtgatgaagctgaagcttctgtccgcatatacagtaataacaacagggatgattaagtcacctttatctgctgttcttgcattaaattcctttgtaaactgtacaatgtttacaccgtgctgacccagagcaggaccaaccggtggtgctggtgttgcctttccagctggaatctgtaatttaatatatcctgttactttctttgccattttggcacctcctaataatgtggtaatgtcggggatttccctcccacgggcctgtgacctacggcccttttacttttgttacaatttctttacttccgcgaatccgatttccaacggtgtttcgcgtcccatcatctcaacatttattgttaccgtacgttttgcttcgttgatgctctggattacactctctgtgtctttccatgcaccacttgtgataacaacgctgtcacccacttcaaaatcaatctgaactactacgttctgaattccaagacgttccatctcagcttctgagagagcaaccggcttggaacccggacctacgaaccctgtaacacctctggtgtttcttacaacataccatgtgtcatcattcattaccatgtgaattaaaacgtatccagggaacatttttttctgaacaattctacgtttgccatctttgttctcttctacgtcctctaagggtacgcgaacttctaaaatttgattttccaggtgtcggttctcaattgtcttatcaatgttggcttttaccttgttttcataccctgaataggtatgtacaacataccaatttgcttctgacatgctttcaccttatccttacttaatcaataaattcaatgcctgcagagctgcactgtcaactgctgaaataagtacacctataatcgcagtaataactacaacagcaacggtctgttttaccagtgtctgctgttccggccagactatctttttaaattcagcctgaagtcctttggtccagcttttctttggagcttttccttttttctctgcttccatagcttcacctcacagccagattattttgtttctttgtgcaaagtatgagccttacagaacttacagtactttttagtttccatacgttccggatggttctttttctcttttgtcatgttgtaattacgctgtttacattctgtgcatgccaatgtgatttttacgcgcacgacttccacctccatgtgtcttttatcgccggcagattcacgtttctgcctttgcaacgtttccttgtttaccgcgacaaatctttttttatcctttgttttaggcacaaaaaaaagacccacttccactgtcgcttttccagtctaacatagatgcaggtctttgtcaattactttattttcttttaacactcatatcgtttatcgttttttatattccgtaattgtttcacggattttgttgtaatccttacatacttcctctacctgttctgcatctggcataacctttctggaacgcaaagcctctgtcaatacagaacttgattctgcaagattatcaaatcccatgttctgtgcaacaccttttaaagtatgcgccgcacgaaacgcagcttccagatcttcctcctccagcgcttttttcagattttcaaaacttggatcttcttcaaatttaaataaaaatttttctactaatttttcattatacagacgccttacggtatcttcataattaccgcctaatgcatcataacactcttttaatgtcatttttttccattctccttaaagtcaaattattttattattctattttttaatactttttgccccatacttttgttcgttactagtaacataaaatactttatcttatttgtcaagtttcttttctctgaaaaaaagaaaaggaaaaacgaaattttcttttctcgtttcccttttctcattcgtgctgattagtcgtcgattccgacgataacagaagttgctttgctgactactcccacaggcaagcctatgaagtttcgccactaaattataacttttatcaatcagatttttcactcaagaagcatgagagactttttcggaaacaccatataagatggtaatggttgttccgttgtctcttttaaatccggtttttcttcgatataccaaagtctcttgctctttggattttcagcatttttaaacaaatgctgattctcaaacggagtctctgtataaccggccgatacaattttcatggaatttattttttccggcacgtctgacggtttcatatagtgtgcccgaatcccaatatattttatggaatcttttacttcttcttccgtttcaaatacaaaatcccagtccctggcatacacactgtgactgcctcttttttctgccgcagaaatatttttacagccggtcaatctcgctgcttccatctttctcggatttgcaaaaatatcggttgtctttccttttaagatacagctgcctttttcaagcagtaccatattgtcacaaaaacgatagatttcatcccttgaatgagaaaccatcagtacatccttttggtattcttcaatcaattccagcatttcaagctgaagcgtatcttttaaaaatccatcgagcgcagaaaatggttcatccaacataattatttccggctgatggagcaacattcttgcaagtgcaaccctctgctgttgtccgccggacagctgggaaggatatcttttttccaaacccgaaagttcaaaacgttcaagctgctcttttatcttcgcccgtttttcttcttttttgccctccattacaaccatcagattctgttctacggtcatagtcggaaataaggcataattttgaaataaatatccgacatttcttttctgaaccggaagattaattttcttctcggaatcaaacaatactcttccatttaatacaattcttccgctgtccggtttttcaattccggcaatacattttaaggtcatgctctttccacagcccgacgcgccgaggattcccatgcatccctcttttgtttcaaattccacatccaatgtaaatccggaaaattttttctttatctttgcctgtagtgccatatcacatccacctgttcacatttttcatattttttcctgatatcagattgatgagtgccacaatcaggaacgataaaattacaatcacacagacccaaaatgcagcggtatcccagtttcctgcggcgacctccgaagcaattgccacggataccgttctggtttttccaagaatatttccagcaagcatggaagttgccccatattctccaattgctcttgcaaatgcaagtaccgtaccggatgcaagtcccggagctgccatcggaacaactaccttccagaaaatttttctctcagacattccaagcgttctccccgcataaatcacatttacgtcaatctgttcaaatgctgctcttgcatttcgatacataagtggaaatgcaatgacaagtgccgcaatcacacagcccggccaggtctgaaccagcttaatgtcaaactgtgtgtataaatactttccaaatggtctccgcagactgaaaatcagtaacagaaagaaacctgctaccgtaggcggaagtaccagtggaagtgtcaataatccatctacaactgcttttgcggtattgtttaatttcataataaaccttgcggctgcaattcctgcaaaaaacgcaagcacagtcgcaagaatacctgttttcagagaaataaaaagaggactccaatctattgtctccaaaatttcagccatagatcttcacccccttttgttcttatttactttttattcttctgtatactgtttaaatcctgcttctgttaataattccatcgaagatggatctgttgcaacatattttttaaattcttctgctgcttttacttctgcatcacttgcttctttatcttcaattaatccaatcggatagatagccgggtcaacctggtctgcagttgcttccgcaattacttcaactttatctgccatagaagctgcatctgttgcatatacaacaccaacttcgttgcttccttctgctaccgctgtaagcactgctgtaacatttgcaccttcgttgatttccatcgccattacatcatcaagatttccgatgttttcaaacaattttcttgcatactgtccaaccggaacatcttcacctgcaagtgcaaggctggaagcctctgtaatattatcaaatcctgtaactgctgtttcttctccggttggtttaattaatacgattttattttccagtaaatttgtcacagaaccatcgattacataaccttcttcagttaaagcatccatctgctttgtagctgccgagaagaaaatgtcgcactgtgcgccttcttcaatctgagtctgaagagttcctgaactatctgcattgtagataatgtttacattcggatgctccgcctcataatttgctttaatttcttccattgtgttctttaagctggctgcgataaacacataaacatctgtcttttcgccggaagcctctgtctcatctgctgcatcagcttcttctttgtctgtctcatccgctgctgcatcttcttttgtgtcttttgcactgctgtcaccagaatcactgcttcctgagccacagcctgcaagcatggttgcaccaagtgtcatagacagtaaaagtgccatcatttttctcttcatatttgttttcttccttcataataactataatttttatggttatattttagaaaacaattcggtcaatgtcaactaataccggcaataaattacaggttttctccatttttctaattacttcactataccagtatgcagaacctttttaaacatactgaaattcattatagtaactatatagtaactattttcttcgtgccctcagttcccttggtttacatccatacgtttcctgaaacatcttattaaataatttataattggtaaatccatgtttttcggttatatcaaggatattttctttggtactgcataaatcatgataaatgtgcatcaaccggatttgatttaaatattttgaaaatgtaacacccatattttctttaaaaaaacggctgaaatactcacggctcagataaaatcgtccggacacttcttctaatgacagtcgttctgtatgatgttcttcaatataatcggtaatctcagaaagcctctccagtcttgtgtcatcttcccgtaacgtaatcgcagtctttggataggaaaaagcgaataacagctttgacataatctgaagcgcaatcgcctgccgttccagccgatagccaagtggctgattgacataaagaggcggcaatttttttaacaggtcgcaaatctgaaaataatcttccagatttgttcttaataattcacttcttcggcagctgattctatacttttccagatttggttctatctgaatcatcgcacttcttgaaaaatgaatcactatcatcatggaagccctggcgcaccttgcttcatgaatctgattggaatccaccacaataaattctccggcaatcatcttatattcttttccttcgattaaaatggtaccgactccatttaaaatatacatcagttcaattgctccatgccagtgagccggtgtgtattctccctgattggtatgatacttgatattaataccatttttttccaattcaaacaaaggttcataaatcatattaacttctccaaattttgcacgccattgcgtgctttctttatttctgtcgacttccttccatttttgtatacaatgtcaatattaaccgaattaatagctaaaaactcatctaaacacttcatatctttcatgctattataacactcgtaaagaacaaagaacagtataaaaaaggagatgttaattatggcaagtactacagctacagctatggtaaaagcaaataaagaagttaaaaaagttacattatgggaacgttttaaaaactatttaattgaaaacgttgatatcattgcaccaggtattatcatgatgaatggcggaacctattttccaaaactgaaataataggctccgccttttttttatcctttaatctgccgttatttctgcctcctgcgtaccatttacattcaaagttttccaaatttagagcagcaaaaaagccctctgacaaaacttaaagttttgccagagggctttctaaaataaattttaattcgttttacaattagtcctcaattgtaactttgtccagatgccagatttcatccacgtactgctgaatggttctgtcagaggagaatttaccggagcatgctgtatttaagagtgctttcttagcccaacctgcttcatctctgtaagcttcttctactcttctttgtgcgtctgcataagatttgaagtcagctaaaataaagtaagtatctgcacggtcactgcagtttgtatttaataaggaatcatagatttcacggaacatttcaaagtcgccgtttgaataagtaccgttaatcaactgcattaatacatttctgatgtccgggtcattattaaagtactgcattgggtcatatccgccattattttcgtagttgataacttcatcagaagacagaccgaagataaatgcattttcttcgcctacttcttctacgatttcaacatttgcaccatccattgtaccaacggtaagtgcaccgtttaacatgaacttcatgttaccggttccggatgcttctttacttgctgtagaaatctgttcggaaacatcagctgcagcaaagatgatttcagcgttggatacacgatagttttcaataaatacaacttttaattttccgttgatggaagcgtcgttgttgatcacgtctgcaactgagttaatcagtttgattgtcagttttgcacgtctgtaaccagcggctgctttggcaccgaagataaaggttctcggataaaaatctctttccggatgttctttaatctgattgtacagatacataacatgcagaatgttcattaactgacgtttgtattcgtgaagtcgttttacctgaacatcaaagatggagttcgggtctacttcgattccgttatgctctaagatatattttgcaagacgcactttattctggtatttaatgttcataaattcctgctgtgctttcttgtcatcggcataaacttttaacttagcaagctgtggcaggtctgtaatccatttgtctccgatgtggtctgtaatccaatctgtcagaagcgggtttgcatgaaccatgaaacgtctctgagtaataccgtttgtcttattgttgaatttttccggatacatttcgtagaaatcttttaattcctgttttttcaggatttcggtatgcagtcttgcaacaccgtttacagaataaccacctgcaattgcaagatgtgccatcttaacctgtccatcataaataatagccattttgcggactttttcctgatttccaggatatttctggttgatttcttcgatgaatctgcggttgatttcttcgataatctggtaaactctaggaagcaatttggagaacagctcgattggccatttttccagtgcttctgccatgatggtatggtttgtgtaagcacaggtatgtgttgtgatatcccatgcatcatcccattcaagtttttcttcatccagaagaatacgcattaattcagcaactgtcattgtcggatgggtatcatttaactggaaggttactttcttcggcaggtcatgaatgtcgctgtgttttttcttgaattttgcgattgctgcctgaatacttgcagaaataaagaagtactgctgttttaaacgaagttctttacctgcatagtgattatcattcggatagagtacgtcacaaatattttttgcaaggttttctgcttctaccgcttttctgtaatcacctttatcaaataagtctaactggaattcattcattgcttctgcatcccagatacgaagagtgtttacaattttgttgttgtaaccaacgattggcatatcgtaaggtacggcacgtactgactgataaccttcctgaatgaagttgtttctgcctgtagccgggtcgtattctacacgaacatatccgccgaattttacttcttttgcatattccggacgacgaagttcaaatggatagccatctttcagccagttatccggaacttctacctgatatccgttttcgattttctgtttgaacagaccatagtggtaacggataccacatccataagcacagtatccaagtgttgcaagggagtctaagaagcaggctgcaagtcgtccaagaccaccattaccaagtgccggatccggctcctggtcttcaattgtatttaaatccagtcctaactcatcaagtgcttcttttacttctttgtatgcacacaggttgattaagttattaccaagtgcacgtcccattaagaactccatggaaagatagtacacaatcttcggatcatctttttcatactgtttctgtgtcaaaagccagttatcaataactacgtcttttaccgccagagaaactgcctggaaaatctgctcctgacttgcctcatccaaggtctttctataaagcatctttacattctcttttacacttttcttgaattcttcttttctgaaatgtgaatctaacatacttttcctcctctgattttttctgtgttttttcatctttttcttctcaaacatcccaaaacacaaaattatattaattatgggagtccccttcttcaagagactcccatagtaatatactgcatgcggcagaattattcggaaattttttctactcctaatgttactttttcagagttgattttccactctttgacatatccggctgtttctgtgtaaacaacatcttctgctaatacctcggatttgatatctgcttcgtgagcacggaaaatcccctcaattacatcattaccgcttaaggaaattttaatcttatccataacttcaaatccggcttctttacgcattgtctgtactttactaatgatttctcttacatatccctcttcaattaactccggagtcagatttgtgtcaagtactactgtgatgtcattgtctgattctgaaacgtacccctccatctgagcagtatcaataagtaaatcactctctaataatacaatctcttcaccagcaatgtcaagtttcagctcaccggttgccttaagttcatccattgctttatttccatctaattcagccagtgctgttttgattgcatttaagtgttttccatatttcggacctactgttctaagctgtggcttaaagctgtaggaagtaaattctcttacgtcatcggtaaatgccatctcttttacatttaactcatctttgatgatatcagtgtagaaatcagacagagtaaaggatgcctttacaaacatttttccaattggctgacggtttttgatatttgctgtatttctgcaggcacgtcccataaccacaatttccagaaggtcttccatgttttcttcgagttctttgtcaatccatgcttcatttacagcagggaaatcacaaagatggatactttccggagctgttttatcaatgcttcttaccagattctgataaatatcttctgtcataaacggaatcatcggtgcagctgcctttgcaactgttaccagtgcggtgtacagagtcatataggcattgattttatcctgttccattccttttgcccagaaacgttcacggcttctgcggacataccagttactcatatcatctacaaattcctgaagtgcacgtgctgtttccggaattttgtaatttgccagattgttgtctaccgtctgaactaaagtatttaacttagacagtaaccatttgtccatgacagcgagtttgtcatactctaatgtatattttgttgcgtcaaattcatcaatgtttgcatacagtacaaagaatgcataggtattccataaagtacccatgaatttacgctgtccttcctgtacggcttttccgtggaaacggtttggcagccatggagcactgtttacatagaaataccagcggattgcatctgcaccgtaagtttcgagtgcgtcaaacggatcaactgcatttcctttggatttactcatcttctgaccattttcatcctgtacgtgaccaagaacgataacattctgatatggtgctttattaaataataacgtagattctgcaagcagagagtagaaccatcctcttgtctggtcaactgcctcagaaataaactgtgccgggaactgcttttcaaatacttctttattttcaaatggatagtgatgctgtgcaaatggcattgctcctgaatcaaaccagcagtcaattacttccggtacacgatgcatggtctttccgcatttcgggcaaggcattgtgatttcatcaatatatggacgatgaagttctactgttttggctttttcgtcaccactgagtttgcagagttcttcacggcttccgacagactgcatacatccacattcacattcccagatatttaatggagttccccaataacggtttcttgaaataccccagtcctgtacgttttccagccagtcaccgaaacgaccttttccgatgctttccggaatccagttgatggtattgttattgcggattaagtcctcttttactgctgtcatcttgataaaccaggattctcttgcatagtagataagaggagtatcgcatctccagcagtgcggataatcatgctcgaatttcggagcatcgaataataaaccttttgcatccaggtcttttaatacttcagggtctgcactcttgacattcgggtctttttccatttctgctttagaaggttttgctctcattcctgcaaatggagtttctgctgtcatgcatcccttttcatctacgaatttaaccagcggaaggtcatattcacgacccacacgggcatcgtcttcaccaaatgccggtgcgatatgaacgataccggtaccatcggacatggttacataatcatcacagattacataatgtgctttcttatgctgtttttctgcttcttttgctgcacattcatacaatgcaacataagattttccttccagatctgttcctttataagtttccagtacttcgtaggccggtttgtcttcttccgctaattttccaagaactttatcaagcagagcttctgccatataataaacataaccgtcaactgattttactttacagtaagtatccgatggatttacacaaagtgcaacgtttgaaggcagagtccatggggttgtggtccatgcaaggaagtaagcatcttcacctactactttaaaacgaaccactgcggaacgttcttttactgttttataaccctgtgcaacttcctgagaagaaagtggtgttccacaacgagggcagtaaggtacaatcttaaatcctttgtaaagcaggtttttattccagatttcttttaatgcccaccactcggattcgatgtaattgtcgtcataagtaacatatggattttccatatcagcccagaaacctacggtagaggagaaatcttcccacattcctttgtatttccatacactttccttacactgctggataaacggctccataccataagcttcaatctgctcttttccatccagacccagtttcttttctacttccagttctacaggaagtccgtgggtatcccatccagcctttcttggaaccatatagcccttcattgtacgatatctcggaatcatatccttgataacacgtgttaacacgtgaccgatatgtggttttccgtttgcagtcggaggaccatcatagaacgtataggtttctccctgctttctctgctccatactttttttgaagatattattatctgcccagaatttttccgtatttttttctctttctacgaaattcatattcgtatcgactttctgatacatcgtgttactcctttctttttttaaaaagaatctctcttgcgagattctccgcctgcggcgggtcgcttttgcgacatgtttccataccgacgcagtgcgaacctcgcggagtgtttttatcatatagaaacgaggttttctatatgataaaaaaaactctcgccctgcaacaggacgagagtaaatcactatcgtttcataccacctcttacacataccaacatacgcgttccttttaacggaggaaaaccggcatcccttactttttatctcaatcgaaaatttcaggcagcaactccggagtgattttcttttgttcttactcgcatcgggcttccaccgtccccgactcgctgttgctttcaacaacaaactactgtctccatcaccgtttttatcttgctttattataaatagggaaagagggaaatgtcaagggggaattcacagtattaaccgtttcatgcaagatggcaaaatcagaacttgttgcagatatagtataaatcccattcgattctataatctgcttcaccaattctctatatcgccaaggctttcccttgtaaaataaattacttcatgataggctatatatacacatgaatatacacgtaaattcacttatcattttatatagataccggtgcagaaaataaaacaggaaaggaaagatagaacatgcagaaaataccacttccaacaggaattgatgattttaaaaagcttcgcagtaataataattattatatagataaaactattttaattgaacaggtcgtagaaacccgaagtgaagttactttattcacacgtccacgtcgttttggaaaatcattaaatatgagtatgcttcaaaatttctttgaaatcggaacagacccttccttatttaataacctgtatatttcaaaaaatacaaacctgtgtgaaaaatatcttggaaaatatcctgtcatttttatcagtttaaaaggaattgatgcagattcctacgaaaaagcccgtgcacagctgataagaacgttaaaccgtgaagcaagaaaattccaatttcttttagaaagtgacaagttaacaaccattgataaaaaattgtttttggaacttttagaccgaaacatggaagaagatgcgattaccagcagccttcaggaattaacggaattattggaaattcattatagccagaaagttatagtactgattgatgaatatgatgtgcccttagcaaaggcgcatgaaaatggttactatgacaaaatggttcttctgattcggaatctatttggaaatgctctaaagacaaacaccagtcttgcatttgctgtcttaactggatgccttagaattgcaaaagaaagtatttttaccggtctcaataactttaaagtctattccattaccaatgttcagtttgatgagacttttggctttactgacgcagaagtaaaagaaatgcttcattactatgaactcgacgataaatacgaagaagtacgagaatggtacgatggatatcactttggaaaagcagatatctactgtccatgggatgtggtaaattactgcaatgaccatttgaataatccagatgcagaaccggaaaattactggatgaatacgagcggaaacagtattatcaatcactttatcgacagcataaatgaaccggatatgcttacgaaaacagaattagaaagacttgtaaatggaaaactggtgcgtaaacgagtcgataaaatgattacttataatgaattgtattccacaatggataatctttggagcaccctttttatgaccggatatctcacacagcaggggaaagaaagtgacggacgctactgtctggcaatcccaaacagagaaatccgaaatattattactgaacggattcttacactgtttcggaatgaggtgaaaaacgatggcaaaatggcggaaaaattctgtcaggcattgataaatcaacagccggaaaaagtcgaagaactgttaaacgcttatttacaaaaaacaatcagtatccgagatactttcgtacaaaaagcatttaaagaaaacttctatcatggtatcttacttggaattttaagctataaaaacaattgggatgtctcatccaatcgagaatctggaaatggattcagtgacattttgattgaaaccgatgatccagaagtcggaattgtaatagaagtcaaatataccgatgacaatggctcaccggaaagtgactgcaaaaatgccttaaaacagattgaaacgaaaaattacgcacaggcgctggaacaggatggaattcggaaaattttgaaatatggaattgcgtttcagatgaagaaatgctgcgttaaaactcaaggttgaatcatatctgaaaaccagtcaaaccattaggtacggggaatttaacatattctccgtacctgatgcattatactaaagcacaatatgaattccatttggttctataatctgctaactgatttgcaatacgctcctgcttttttgatggttctcctgcataaaaagcgattttattgaaagtaaaatgattgatttcaggaattgagatagaatcttttaagaaaaactctacatcttttcccaatgcctgtgctattttttccatatctgtaccactttcatcctgcactccggttaacaagcgagataatttattcttatcaatccctgtcagcatactaagacagttctgcttaattttcatctccgacagatatttgtttaaattatttataaattttgtcatgttattctatcctctttagtgttgtgacggtttacactttataatatatcatacacctttcttcttatttatcgatatttttcttatttatcgatatttttcctattttttgagattttaaattgtttttttgctttaatttgatttttattttttattaatctattatattttcttattttttgagtgtttcaacgaatggaaataaaatagaagcttccaattctacttctatgtaaattgaagctattaaatttaatagcgacttataaatttgatagtaactttaaaaataatcacctccaggctataatgaagcaaaatgatagcttaaaggtgattttatatggcgagatataagaaaaaattagagaacgtcctcccccaaccgctaagccggttgagggagaacaagcgaatattccgtatcgtggttacgatttttcgaatccgtacatccattttcctcgtaagaacagatacagaaagatcacggaactgatactccaggttaatgggtatgcccagaaaatcactcgtatatctgggagaatacgaactgccacagtaatgtagcttacgcgaaacagacaccagtcacataacataacgatcattggaacggaggcattgcctgagccacgaagtactgctgcgatacaatgagaaaatgccagcaaacaataaaataatgcaataattctagcctgcatgactccataatgcacaacatcaggatctctgttaaaggctgtgatcagtatcggtgctgccgcatatatgataatacctatcaattctgcaatcgcaatcgaacaaagtacaccaaattttgctccctttttcgcccggtcatactgttttgcacccagattttgactgacaaaggttgtcagagccatcgtaaaacaggttaccggcaaaaaggcgaatccctctatcttagaatatgagccacatcctgccattgccatttttccaaatgcatttatatttgactgtacaaaaacatttgcgatcgcaatcactgaattctgaaaaccggatggtacaccattctggatgatctgctttagcataaaactgtcaaagcgaatctctcgcaattccagacggtattcctcttccactcgcagcagatgaaccatacagagcagtgcactgacaaactgtgaaattgcagtcgcaagtgctgctgatccgacacccataccaagacctgcgataaagaaaatatccagaacgacattgacacaggaagaaataatcagatatatcagtggatgacgtccatcaccgactgactgcagaactccaacaaagatattgtacatgacaacacctatagagcctgcaaaatatgtacggaaatacacaatagattctgggagcacatctgcaggagttcccatcaataccaggatctttggtgccagaaacatccccagaacggtcagcaaagcaccggacacaagcccgaatgcaaccgttgtgtggattgccttttgcagaaagtcactttttttagctccataatatcgtgcaataacaacacctgcacccatggcaatgccgttaataaaacctaccattagaaaaatcagatttccggatgaactgaccgccgccaacgcattacttccaagaaaatttcctacaatcagggaatcagcagtattgtacaattgctgaaacagatttcccagaaacaatggaattgcaaaaaaaatgatcttttgggagatacttccctctgtcattctcagactctttttcatagccaaaattaccctttcccttcctgcgttctttgcgtgaatagagataaaggactgctctttatggcagttatctctctataattagtgaactactcagctacaaataaccgagcttcttgcttaaaaattaattggctttctgtcggttaataaatgatagaaaaaaccagtctaatcatatcacttaccctttatgttttcaaataaaatccttaatttttctcatctaatctcattttttttcattttcttaatgaatccttagttgagatatcgccataaatggactatactattaaaatgtgagtgtcaaagttaattttgccacttaccaatgtacatttttttataaggggtttttattttatgaatcatttaaaacatcgggtaatctctgctgtctgttcgattacccttttatccggcactttttcacttccggtttttgccgccgacgcaaactcttccgaaaacacggaagcaatttctcagacttctgaaactgctgcaccgactgatactacaactgcccaatcttctgatccagcttctacagatactacatctggcacaccgccgactgacccaaatgctccgcctgaaagttacaactgggaagttcaatccgattcctgggcttcctggccaaaaggtccgcaagtcgctgccgaaactgccattttaatggacgtcgattcaggcgaaattttatatgcaaagggaattgatgaaaagcgctatcctgcaagtaccacaaagattatgactgcatggcttgcgattgaaaacagcaatttatccgaccaaatcacgttttccacagatgccgtctacagtattgaacccggaagcacccacattggaatcaaaccgggtgaaattcttacaatggagcaaagcctttatgcggttctgcttgcttccgcaaatgaagtctccaatggcgtagccgaatatgtcggcggtggaagtatctctgcttttgtcgataaaatgaatgaacgtgctgcgtcccttggctgtaacaacacacattttatgaatccaagcggtctgcacgatgacaatcattatacaaccgcacgtgacctggctacaattgcccgttccgctttccaaaacaaaattttccgaaaaatcattggaacagaatattatatagaaccaaaaacaaatatcactgatgaagaacgctggcttaataatcataacaaaatgctgctctccggtgaaaaacattatgatggctgtcttggcggaaaaaccggctacactacaaccgccggaaatactttagtcacctttgccgaacgtgacaacatgcgtctggtctgtgttgtccttgccgacaccctgcgttttcagtacagtgatacggcttcgctgtttgattatggatttgggaattttcataaagaagtgataacagaaaatcagccggaaactactgttcaattactgcctgcggatgcgttttcgctgaaaatgacaactcccgaatttctctcctgcgtggaaaacggcaactgcgtaaccctgccaaatgatgtgtctttagattcggttacttatgaaacacgcgtggaaggcgattccgtatttactgactgtctctttaacaatcagatattaatgacgaaacaggtaaagattttaccatcaaaatcaattcaaaaatcatttaaagcgatgaatcaaaaaaagacatcaaaatcaaaaaaggcgaaaaaaagacatcactgatgtcttttttcacgccttttttcccgaagcagatttcgtttttcccgaatctcaactgcttcttcttcattaattttctttactgtttttactacataataattgccttcatcggttttcttcaaccggattttcccttttaaataaccgtgttccggacaatatgccaggcagacatgggatttggtattcatagaaaaccagcgtattttcttctttgctgtattattacaaacaatgcattttgtacttacgacttccctgtctttcattgcgtcttcttttgttggaaattctcttgaaatatattttgaataattctcaaacatgacatgaatttcttcttttttggatttcggattctgataagtatcaatcgagtaatttttctcaaccacctcaatcggcaattttgcaaacacctctgccgtataccaggcatcatgaagtgcacggtgaaaactctctgtcttttctattttaagaaaatcaattgcatattccagggaacggcagttttttttaccctcacaggcaatcccaaagattttctgaaggtcataataacgaaccggtccttctaagaaatgcagcatggtatagtatttcaaatttcgctgaagttcaatcaaatcagttggtccccaggtacaaaatacaacgtcctctccacaccatctcaaaaaacgccttactgattttgaaaaagaaagcccgctctctaaggtatttttatcaatgtttaaaatttcttttgttcgataatgaagtctgtgatagacagccggttttacaatctgctggaatttatcaattacttctcgattttcatctaattttaccgctccaaattcaataatttcaaacggcaatcttttattttcacggtcttttccataaggacactggttccactctaagtcaaatacaatataattcatttctttcttctcactaactaactatttactctgctgctgtaatattaccatgatgacctcttattcgcaactgaaaatcatagtacagaaaaaaaagcaatacatacttttacaaatatgtattgcttcttctctttgttttttattcttccgctccaatctgcggcattggctctgccagaattttcataaattcttcacctgtaattgtttcattatcgtaaagatattttgcaagctgatgcagttttccgatattatcctcgagaatcttataagcttttgcatgctgggtttttaccagttccacaacttttttatcaatctcagtctgagtttcaaatgagcatgcaagggaagtatctccacctaagtactggttctgaacactttccattgccaccatatcaaaatcatcactcataccgtaacgggtaatcatacctcgggcaagctttgtcgcctgctcgatatcattggacgcacctgttgtaatggaatggaaaatcaattcttccgcagctcgtcccccggtaaaggttgcaatcttattttcgagttcttcttttgacatcagataatgctcgccatcttccacctgcattgtataaccaagtgcaccggaggttctcggaataattgtaatcttatgaaccggtgcagaatttgtctgcatcgctgctacaagcgcatgtccgatttcatgataggaaacaatcaatttttctttttctgaaagtacacggctcttcttctgataaccggcaataacaacctcgatactttcttccatatcagcctgtgttgcaaattttcttctgtcacgcaccgcacgaagcgctgcctcatttacgatgttggcaagttctgcaccggacgcaccggacgctgcttttgcaatttctctaaagtccacattatctgaaactttaatctttttcgcatgtacttttaaaatttcttcacgtccctgcagatccggaagttcaaccggaattcgtctgtcaaaacgacccggacgaagcagtgcaggatcaagtgaatccgggcggttggttgctgccagaataacaacaccttttgaaccgtcgaaaccatccatttctgtcaaaagctggttcaaggtctgctcacgctcatcatttccaccgatatttccatctcgttttttaccgatggtatcaatctcatcgataaatacaatacatggggctttttcatttgcctgtttaaataaatctcttacctttgctgcacccataccaacgaacatttcaacaaactctgaacccgagatagagaagaaaggtacatttgcttcaccggctactgcctttgcaagcagggttttaccggttccgggaggacctacaagaagagcaccttttggcatagaagctccgatttctctgtatttttccggattatgcaggtaatctacaatctctgtcaaaagttcttttgcctcatcttcacctgcgacatcagaaaatttaattcctgtggaagatttcacgtaaatctttgcattactctttccaaatgacattgctccaccggcgccaccaccgataccactcatcattttcttactgagccagtttccgataaatacaaaaatcagaatcggaacgatataagacaataataagcttacaatcggagaagttttctgcggaatttcttctgagaattttactcctgcatcttttaagcgttctacttcctgtgagtctttgattcgaccggtcttataaacctgcgtctcatttcctttttttacagaatagtagatgacatcatcttccagattgacttcttctaccgttccactgtcgagagtatccaagaactcatcataagtggcttccttgatacttctctctgcaaggcttggtaccaaaagtgtatttaacagcaccaacacaataattacgattgcataataaaatatcaagggtttttttggctttttatcttttatctccatagccatatcccctttcttttttctttgtaaactactcggcaaccaagttaccaaagcatctaaattaagtagttccttaacacttgctatactaactattactattatgcgccaatttttacctatttacaattaagaaaccctgttaattctctaaaaaaaaaatgaaatttccagttacttatcttaattaattatcttctccggttaatcttaagattccctggatttcttccaaatccatatccaaaaatgcagataactcttcggcactgtatttatcatcatcatcatccatgatttctttgattttatgctccagatttcttactttttctactaaaatatcatcgctctgtttctgatctgtctgttcctctaacagcaataaaattgcatttctgatttcaccggataaaaatgcagaaatatcttctgcttcctcaagactttccagtgcgccaatcaagccgatatttccctcagaaaccatatctccaagaaaaacctctccgtcatgcagctcttttgcaattttaagcacttctttcatatataattctgttaatcttgattttgcctgtgcctctcctgcttttgctaattcaaaaagacgttctctttcgccttcctcttccggaagaatcacatttaatgtttcaagataatcctctaaatattccttctcttcctgtgtcagctcggtcgattttttctcttcttctgcctcctctgcttcataagaaaacatagaacttttctttggcatttctggctctgaaactttttctgctttctttttctcttcatccgtatggattccctgaatggtcagataatcatatactttctgaagctgtgtctcatttaagccatctcccgcaaaaaaatcctccactacctcacggctgatttttcttccattgttgactgcaagtctctgtatatcctgtaatttctgctgaaattctttaatttccattctaacctaacacactcctttttctcacccaattccacccagtgcaattccaagaatcaacaccagaatgcaaatcggaacatataaatatttgcaaaccggataaaaccatttcgtaaatgctttttctcttcctttattgacctgttcttccacgtatttctttccgcatacccagaagaacataattcctgccagtcctgctccgagcggacagatataaatcgacagcacatccatccagtccgatacaattccctgaatcaaaagggaaatcacaattccaactatacctgtcaaagtacatgccggtactctgccaagttttaatttttcttgaaccgtcgcaatcggtgcttcgtaaagattaattaaagaggtcattcctgccagtaaaactgcaacaaaaaagagaatcgcaatcacatgccctccgggcatagatttcatcagatttggaagataaataaataataatccaggtcctccctgatttaatttcgcaccggtcgttgccattgccggaataatgacaagtgctgcaagcattgccgcaagcgtatcaaaaaacgccacacgtcccgcagatgccggaatattctcttcatccgaaagataagaaccataaatcaaagttccgtttccagctacagaaagggagaaaaatgcctgacccagtgcaaaaatccatgttttcggatttgcaagtgcagatttatctactccaaaaatatatcgatatccatccgatgctccctgctgaaatgatacatagattccaagtcctataaataatgcaaagaaaatcggcatcataattttgttcgctttttcaattcctgttgctacaccgaacatcaaaattcccatgcagagaattaagactaccacctgccagatattatttccaaatgcagatgccattgaaccaaactgtgcaccaaactcatctacactttccggtgcaagcgttgctccggtaagcgtacccacagtgtattttaaaatccatcccataactacagtatagccgattgccattgccattgaaccaagtaccggtatcatgccaagcagttctccgctctttctgcttccttttctttccgtcgccattccaaatgcatcaatcggtccggaacgtgctgcacgcccaaaacacatctctcctataactccggtcgaaccgattagaattacaaaaataatatagggaattaaaaaagctccgcctccgtacagggaaactctggtggaaaacatccagatattccccataccaacagccgagccgatgcaggccaaaataaatccccacctgctgttaaatgattctcgtttcttcataaaatttactcgttttctccttgtatattttgtatttgaattataacaaaattcaggagaaaagtaaattttgtttgtaacttattcagcttggttcttccattttgttccaagttcttttaattcttccgcagtgtaaagcggacaaatccagtatttttcttccagccagtttttcattaatactttattttctttttgagaatagcctgcaaactgacctttgacatcatcgccgatttcatagcggatttccattttatccagattaattaaccaggcctgattttgattttgaagtaaaatctcatcaggattttgtgttttccagactacaacatattccgacttttctgcatcatcttctttcttctctttaattgtaatctgctcttctattccatctgaatttttatttactttataaagaatcccgtctctgccaaatacaaatacataatctccaattttatgactccagaaaacagaagataccagattcttctcttgaagcttttctatcaccggttttattttttttgacttcgtgtcgtccgagtactttacatttttatccttagtctgataaatcagactatcctcttcctctataatttcacacgattcattcgttaaatcctgataacgatagaccacatttccacttaccgccagttcatcatcattataccaggcagaagcatcgatttcagatgcaaattcatgaatcactgcacctactgatttttctttttcccctttttctattccatttacaaaaagcatatattcttttccattttctaaagtcactaaaatctgacctgcttctgtataatctatatttataatactgctcggaaatgtatattcataaataatatctccggtattcacatcaatcaaataaatttcttttgtcataacagtgaataaaatatccgtatagttttccgtattttctttcttaaatgttcctaccgctaaatcttccatataagtagctgagccatttaccgttacttctgaaagtttttttgctgtattataatcaaaaatccgatactttgtatactctccctgcgttcccatatttgtctctgttatgagataatcacccgtatgcattactgtaggaaccccttctttttcctggtctacgatttcttccaataacggcttttcatcttttaaaattactccatcttttacagaatatgcttttatcttattttcacaatttccaccttccttatattctgtttcattcacataacaaattttatcagagattgattgtatatctaaatcaaaaaggtcatcccattctttggtatatttatattcctttttattttcaatattgttctcatcaaatacaatcagactacagttaccattttgattccacatacccggaatctctttcgcttcttcatactcttcataaattcgggcaatctttccatcaaacatccgataactgtaagtataagtatcactgtcataatgccactttttttcttcttcacttacttcttcaattcgttcataacttccatccgccggattcactttccagacctggtctacgctggtaagataaaaacatggattttcagcctctccttcacttgtagtttttttatagccataaagcatcatttcacttgtcagttcaccatctgactgaccattgccttccgctgaaactttttctaattttattacttttaatggttcttttttaggaataaaaaacttaacactataagtgtcatcgtcatattttatccccaactcctccaccgtatatttcttcaccagttttccgctctttgtctcccacagataaacccctgttgcatcctgtgccaccacattttttccactgtttacaaatgcaactttcgtaatatatgaagttgtctcatatttttgtaccggcaaaaagttttctctctgaaataatcccagtttttctgcggttgctttctctgccgaaaaaaccgacatattatcttcagcatcaggaagtgcatccactgctgtctcaattgcttctgtcacttttccatcttcccacatataatccgactgaacagccatacgattgtagttttcttcctgcaagagccgtttttgttcatttaatcggactgccatgattgaactgtagataccaattccgccaactacaactgttactccgcccatgacggcaagacttctgtgaatttttcgtttctgttcccgctgatataaatcatcataacgacagtcaagcagtggtgcggcaattcgcaaatattctgtttttaatttctttaatgatttcctttcagaatctgcggttatattcgcagccagaggctctacttcaattttctcccgaatttcttctccctctgcatttttacgaatttcttccgaccagcagagttcttccggaaatacatcgcctggatttccttcaattaaaagtgccagtatgtttttggttgaattattatgtaacgatttaaaatatgaaatttcttccctgcaccattttgactgtgcaagcatagaagaacaaattacaattaaatattctgaattttctaatgcctcacggatatcctgactcaaatcagcacttgtcggcagttccgtttcatctcgaaatactctccatttttcctttttttcaagctgtttcggaggatgaaatgtctctaaatgcttctgtaatgtaactgcaacttttcggtcaaatggctgatgccggtagctgataaaagctttatatctccggttattctgctctgtcttattatctgtcttattttctgttttctctcctgtctcaagctctttctccatcttctttctctctttctttcaaccattctaatgccagaagtcttttggtatctttgatatttgccatatcataactgtaaaaatctttatccattccacattcattttttaatgcaagttttaattctttctgaccctcataagcacagatacaaggatgcagctttgccacaaacaattgctgtctttcatttccacatttaacggcaaaaacagcatcatctgcacttgcagggagccagccacgggacaacatccatcttacccagcggtcatgttcccagaccgctatcgtcttatattcactttcttttactcctctacttcgatttgccagataattcagctgttccaccgaagcaaatgccttctcgtcccagatttcccatgcaatcggcataatctgatttccattaatatcccgaaactggaaaatacgatacggcatgctaagagccagactataggaactgtcatgattatattgtcttccataatagaccttatcttgctgttctgccttttcactgcccgctttggtctcttccggactcagccccgcaaactgataatgaatacactttgaaagtttttcaaaagttcctccagccatcaaatcccagctataatatgccgaaagatttccaaacggaataaaggaccaggtattaaaccatctgtctccatatatttccttttcaattaccagtctttttgcagtccatgcaatctggtctttccgacacagaactgcaatcggatttggattctccagtgctgtctcatttctctgttcaatattattacgaaccagaatttcacggattcttgttgccagtgaaagattttcttcatctgattcagtcgctaccgcaaaataaccatacggagtttcattcattatgttctttaagatatccgctaactgaaaagaatgaaaatcaatattttctcctaaaacctccggcagttcaatctcttctacatcaaaatcgctttttaccattcccgggtattctgcctttattttacgaacaaattcttcgcctttctcatctaacaccgtaatcttacataaaatcgcattttcacgaaatcccatcatccagaatgcttcacgaaccagccatttcgcaactctcgatgttcccaaaataataaaatgcaggattggtctgtcttcttttaatttttttgcactttcctttaaatctaccgcacgaaccggataaaacaaagggtgatgagatagcagctgttgtgctgctgttttatcatcatcaattataaaaacaggaatcgtatactccggaagaccacttaatgctgtgtcaatcagagcacgggcgatttctgaatcatttcggataaaaatttctatattcagttctttggtctctggtttttcatcttttattaactgtaataattatgtgaaattttatatctaattttcgattatccgcataaacactatactttcaagtattttgaagtatagaaaaccatttattttaccacgaatttaccacgattgaacgagccttgatatgacactaaaaataacatgggagatagtacaaaatatctgactatctcccgtctttcttaattttattgtaacacttaatgagtatcgtctttttctaactgttcttgcacaaatttaatactattctggataaattctttatctttttctgttgcaacttcttctaattgtttaaacaaagcaatgctttcatttcgtttacctaatacattaaatgcagttgcaatattaagataccatgtcatttcatctttcatatctttaggcttcatatccattgcaagaagtttttctaaaaagagttctccgtttttggtttcttgatattcttttacaatatcattgttcatttttctaaactgacgtcctctccgcattaaaacaaagaatacaataaagaaataaacaatagtaataacggcaataccgccaacgataatgcctaaaaaaccaattgttgattttacatagggaattactatgttcacataaataaatagtagtaccgcccaaaatagaaaggctaatcggataagccatttatctcttttttcatatattgctcttttattttttagattttcgggttcgtaaatcattttttcactcctttattactacatcactcagaatttgttgcattattttgttttttccattccttataatctttttttgtttcttgttgtcttttaacatcttccattttttccaaaatcacttctacctctggttgactgtgttgttcgggtaaagaatagaaaataaggttattatcgtttgtatatactgaaatattaaaaaccaaatcactttctacaatttcttgcatgatataggaaatttcttctgcatattctttatcagtttttccctcattaagatatatacttgtttctatttcatattccctttttttcagatattcttctacactttccttaccattccattctgttgtggttgtatgcccttgaacttcaatttgataacctcttataaaaggcttatcttgaaataaaggagttgcaagttcttttatttcatcagaatagtaataaacatggtaactatcctcgaaaagtccagtatttcgtgtatatacagtagcagtttgagaagaattttctttactggaaacatttgccctaatccagtttaatcctattttttcttctttgtacttcttcacttctgtaatgataaattcttcattgtatttgtcctttaatttggataagatatatttttgtgcttcttcactagagttaaaatcatgcgaataaccgctacaaccatttaatagtcctagacagagtacgcttgctataacgcctaataaaaattttttatatcgcataattgccacctcaatgtgattttataatttaatactgttctacaaactggaattttttgacactgttaataggcatgtgcttcaatatttttctaatttgattattttatacatctcccccatatattcccctattttgataatttagaattgtatgatacatttcttcatcatcatattcacatgctttagcttcatcagaagaaatctcgattctttttttctttatcatatgtgttccagcatcatattctaaataatatttacttttacacttaatcagtcttattccttcattctctttaactacttccatatttccctcattcaagtcaaagttactttagtttgcacattctttatttatgttcgattgaaatgcttattttacaatgtccgttttttctatcaaaccatttgtgatatttataaaatatcttttaccataaaaatctgttgctgtcagtattctattgttaagaaatatattttcaaatggtaaattacgtctgttaggctttcgattttctactttccatatgattttacaatctaaagaaattgcatatatattagatatttcatcaacaccaaatggtattgataataatataataacttgattatcaactaccttgatgtctcttatgtcgtaattaaacttaattgtatttttatcaatgcttaattcatttttgttgattttaataacggtattcattttctacctctaatcttaagttaacatagatttacaacttcaaactggaatttacatttataaatacttttcatagttactcaataattcaagataaaatggtcgcaagcaggtttggtcaacatcattttcaaattccaagacttgttccgagccaattctatcgcccttatggagataacctttaatagcaatgtgtcctctgttattacctacaaaggacatatacatatgttgtccataagattcctcaagtcttgcattgccttgcaaagtttcgtagatttgacataaatcttttccaagtttagccaagtcctttatatctatatccatagttgtactcgctgtaaagccattacttttaacatcaattttaagtattgtgtttgttgataaatttatatctgcttcaaagatttcaggctcaatacaaacaaaaaaattttctgtttcaataatatgtttcattatgtgtcacaccccaattccgatttgtcgctttcttcatgcccatattataacagttccatatatccaccacaataaaaatcaacataccctttaaatattttctgcattgaacatacacactttttctttcttcctcttgattacccaccacagaaaagaaaaagccctgtcaagagccttgccaccattggtggtgctttgcactctttactgggctttttgtttgctgtatcttccatgcaagaggaaattaaagacctctgttccatttcgcctttagataatcttcataatctccctcattaaagtctacttgtggagaagtattaggaatattttttctgttatctatatctgcaagttgacggaatatccagtcatcataagggttgtgatatttgtattctttcggctgttctctgtatcggtctaaccctcgcatttccttatgcactttcatcatgcgttctattttttgtcgttgtatcaactgtttgatttccataagttcttcaatttctacaacctcattagaaagataattactgatgtatctaatcaatatggtttccatgtaaaatctgtattcgttttcattttcaaaaaattcattttcagacagataatctaaagaaacattgaagtcttgttcccgtttgataatatccatgatatatggctcggtgtggtcgacatacttccattctcccgataataattcattgggcgttacacccagcacgtccattatcttttccagcgtatcaaaggtaggataattcacaccacgttcaatcttggaaaggctctgcatattgataccgattttgtccgcaagttcctgttgtttcattcctctgtattttcttatggtttgtatgttctctcctaagaaactgattttcttttcataatgctccataacttggtataaccgctcctttcgttgctttttttgacatttataagcatatcatacttaatctatatccaaaagtcaacaaaaacttcttgacaagtaattctaatggcgttattatcgtgttagatagagtgattaagcacgctagggtcaatcacacgcttgagtaagcatatagaatagatattttcactttgatagcatgaataggcatggactatcagactgaaaatcgggtttctgactgggctgttccgtttagccacgagccttacaaggctcgtgagcgttaagaacggggcagacacaggaagaaagggaacgcctttaggcgttcgtaaagggcgtatatgtaacaccgccctgcgcatacatgtcatagtacctagaaactgtgataaataaaggaaaaaacacgatttttaccccgcaaaaaacggggcatacgaaaggagtaatgcactataactacacacaaaaatttatccgttaagattgattacatcagtattgtatttgatactgcaaccgctgaagatatcatcatgcacattttaggtttaccgactgatattttcaatgtctatccggcaagcattaaatacaaaacctatcaagcacgctggcagattggagatatttatgtatcgggggacgcaaggaaaacagaggacaacccacaagggttaggctgttatcttgttatgaccggcagaggttgtgatgatattttccgtattctcgacagtaggaattatacctttggggatatgttcaaacattgtgagcgaagatacggacgggataacttccacttcacaaggcttgatattgccattgacgataaaaacgaaaagccattttttaccatagagcagataaagaagaaatgcgaaaaagaggaatttatctcgaatagtgagggctaccactttgatgaaagcaagtttgatgatttcgacaccgcaaagactgtttatatcggtgctggtaaatcgggattgtcctaccgcttttatgataaggataaggaagtctgttcaaaacataataagacgcttgaggaagtcggcagttggaaacggacagaaatgcaactgcgtgatgataaggctcatgcttttgccatgacattcaagggcagaccgctggaacttggggaactggctttcggactgctggcaaacaacctacgctttgtcgtaccaaacagaaacgaaagtaataagagcaggtggaaaacttgtcggttttgggaacgctttttaggggctgtggaagtcttgaaactgcaagtaccaaaacagcaaaattcccttgaagaaacacagcaatggctcacagagggtggcgtgatttccgctgtcaaaagtttttacttcttggaagaacatgacgcattaggtggactggaaaaagtgggaactatgcttgataaggcaagatacagcaattccctttccagtaaattaaccgcccatttacagaggataaaccgcaccgaccttatcccctatatccagtatgacacgaaacatgggaaagggggtatctgatgaacaacaacgatattcccgtatgggaaaaatacacccttaccattgaagaagcgtcaaggtatttccgtatcggagaaaacaagttaagacgcttggcagaggaaaacaaggacgctggctggctcattatgaatggcaaccgcatacagattaaacgccgacagtttgaacaggttattgacaaattggacgctatttagtgcaaatgagccttgtatgtgttatgatgaacacaagtcatatcaaggctctttccaacaaggaaaggagcagacaccatgaaagaaaaaagacgggataacaaaggtcgtatcctgcatactggagagagccaacgaacagacggaaaatacttatataaatatgtagacgcatttggaaacacaaaatatgtgtatgcttggagattgacacccacagacccgacaccaaagggaaaacgggaaaaaccctcacttcgagaactggaacagcagataagacgggatattgaggacggtatcgacagcacaggcaagaaaatgacgctctgccaactctatgccaaacagaacgcacagagggcaaatgtgaagaaaagcacaatgaaacaacgggaacaactcatgcggttattaaaagaggataagttaggtgctaggagcattgatacaatcaagccctctgacgctaaagaatgggcgttacgcatgaaagacaaaggcttttcctacaataccattaacaaccataaacgctcgttaaaagcgtcattctatatcgctatacaagacgattgcgtaaggaagaacccttttgatttcaagttaaatgaagtcctagaaaatgataccaaagagaaagtcgcattgacagaggaacaggaacaagccttattgtcatttattaagacggacaatgtgtatcacaagcattatgatgatgtgctgatactgttaaaaacaggacttcgtatctcggaactgtgcggtctgacagtagccgatattgatttcaagaatgaagttgtgattatcgaccaccagttactaaagagcaaggaacaaggctattatattgaaacgcctaagacgaaaagcggaataaggcaagtaccattaagcagagaaacgatacaggcatttcaacgggttatgaagaaacgcccaaaggcagaaccatttgtgatagacggacagggcaatttcctatttgtcaatcataagggcaagccaaaagttgcgattgattacaacgccttatttgtccgtatggtaaagaaatacaacaagcaccacaaagacaatcccttgccacatatcacaccgcatacgctacgccatacgttctgcacaaggctggcaagcaagaacatgaacccaaaagatttacagtatatcatggggcattcaaacattagtatcacaatgaattggtacgctcatgcgtccatagataccgcaaaatcagaggttcagcgtctaatcgcataaaagtatttaccacgattttaacaacgattgatagagaaaatataagaagatagacctagatatgcgaggtttaccacaaaagcaaaatgcccgtagagcctataaaataaggctttgcggacatttaagaagatataaaaagatagtcaaaaagacatatataatttcaaataaatcttctatatttttttcaaaatcatcatccaaaaacaaaaaacgttttgccgttttttcatgaattttcatttgcattaccgtcagatcaaactctgcaagccatctctcccagctttccgggatcgtcttttcgaatattttggcatatttattctttgtatttgaatagcatcgtcccactgtggcagtttctgcccgcataacctggggtataatccgactctcattatttactttccactcttcctgcgccagataaaatccacagttattactgattttcagataataatctgcagtttcatttgttgaagattgatattttcctgcacgaatatatttatataatacaaatgctgcctctccacgataacttttctctactgcaggtgttaaatatagaattttctcacagcctttgcagcatctcatcacatcttctccatcagatgccggattttgataaatgattcgtattttctctaacatagcttcagcatctgcattatttttccaaagttttgccggttcataagaaaacttaactgcctcttttaaaaatgcattacctgcttttttatcttttagctgataggctcgccttgcaagcagataattggcttttcctttctcgtatggattgtttaatgcaatccccagacattcttttagttcttccagtgagccttcttctctatgaagcatttcctgagctatttttatcgcatccgattcttcctcttcttccacaagcttcggcagaaataaactatgaagttttaaatcctgttccgaaaatttcgtattttccattccaaaactgcataacgtagatgcaataatcgaaaatactgcaagaatctgtgcatattcctgtttatcataaagctgaaataatctttccttgataaacaattcatctttttcttcctcaattttatcaatcagacgataaactgctttcgcaactttattttcctgcgtctctgtacatgcaggtactaatcgtttccagttttctgcgaattcctgaagcattggattttcttcaaaattataatcctcatgcgcctcattttttaactgaatcagataatcactcgcatccagaaaacgtttttttgcatcaatagtcgcacggcagactaaagaaacatattttccctgaactttcccacttcttacaaacattttttgatataaaccatccggaaaaatttcttttataaatgttttctggtctgactcattttttgtaaatttgacataaatatcttcatataattgtttccaagtaatttctatcttccacacagcgaatccccctgagttgttttatgatttcattatacctcattcgatgcataatatcttgcatttatcttataattctactcttttttctttcgatattaagatataataaaagcagattaaaattcaaaagggggaaattcaccatgacaaaacactacatagaatccgatattcgaaataattaccgtgccttaaccaaatgtttaattgaaaaacacttaagcatcaccacaatggaaagtgcaacttccggtcagattgcctctttaattactgatacggaaggggcttctgccattttaaaaggggcttttatcacctactcaaacgaagccaaaattatgcagggtgttccggctgaaattattgacacttactctgtctattcaaaagaaaccgccgaagcaatggcatgtgcctgtgcaaaagcttatcttgccgatattggaatcggtgtaaccggcacaatgggaaatattgacccagccaatctgaatgattctgttccgggtcaggtctattttgcaattaaaattcataataccgtttcatcttactatgttgaattagagccacagccgaccagactcgcctataaacttgctgtggcaaaagaagtatatgataaattaatcgaaatactggaaagttaaagtcaaacaggcagtgtccatccctttagacactgcctgtttgcctcatttcttcaaaatttgttctatagtattcaactcaagtatcttcatgtgtgccaaacaatttctcgcatttctatagtcttcaaagtggcttagaattccagataccgtctttttcagaaaatctttctttcccagttgttgtttccaattgttttccatgtaattgccggtaagcacgaggtccgctgccataatatttttcaaaggtagctgcaaagtgttgtctgctgttataaccggtatgaaatgcaatatcagtaatcgttaaagaactgttgattagcaaaaatgctgcctgctccagtcgttttcgattaatgtagtctgtaattgtacagtgcatttgtctggaaaatagagattgcagataagatttattgattcctgcatatcgagcaatctcaggaattcgaagttcttctgttaagtttttacgaatataatcacaggctttttttaaataaagagctccggttgtggattggccttgataaagacatcttgagagttctaacaacatccgaaaaaaaagcagacaaatcaaataatcggaatcaaatttctgaagatgtttttgacgctgaagacgtaaatcatccaaagaaagtgtcaactctaattgagaaatcaaatcttttaaagagtatcccagattataaatatctgttccagttaaatgagagcaggaatctttgcaaagtttcaggaataaatcactctcctttataagttcagataaattgatttttgttctttcttcctgacaggaaaattccaaattcagcatggaacaaaattggtcttcttcaataaataatcggtgtgggagatttgcatcaataaaaatgaattgatgagcttctaaaaggtgcttctctttttcaataaatacttcacagcaacctttggtcacatacatgatttcaaaacttggatgagaatgaaggttcatcttataatcactaagagaaagtgcataaaaagcagtgagtgaaatgtatggttttgatggataatacaaattcatgataaaaattctccttaaataaaatacggtaatatcttgcattttttaatgaaatcaacaatagtttacacctaaaaaaaatgctttgtctataatgaattcatagataagaacgatagaaacaggaggttttatttatgagttttaaaatagcatttatcggagcaggaagtcttgtatttgcaagaacactttttacagatattatgtctgtaccggagcttagaaaagcagaaatttcttttacagatatcaacccgtataatctggaaaaaacaagagcactttgccagagagaccttgatgcaaaccaaattccggttacgattcaggcaacaacagacagaagagaggcatttaaagatgcgcgttatatcataaactgtgttcgtatcggaggactggaaggatttgaaacagatatcgaaattccgttaaaatatggagtggaccagtgtgttggtgatacgttatgtacaggtggaattatgtacggacaacgtgtaattgctgcaatgctggatttttgtaaagatattcgtgaagttgcagaacctggtgcaattatgttgaactattccaatccaaatgcaatggcaacctgggcatgtaataaatatggaaaagtaagaaccatcggattatgccatggagaaattcacggagagatgcagattgcagaagtactgggaattccgagagaagaactggatattacctgtgccggaatcaatcatcagacctggtatatttctgtgaaacatcatggagaagaattgttagaccagattcttcctggatttgaagcacatgaaaaattcagagaagaagaaaaagtaagaattgatatcttaaaacgttttggatattattcaaccgaatcaaatggtcatctttctgaatatgttgcatggtatcgaaaacgtccggatgaaatcaaggactggattaatctggataattggattaatggagagactggcggatatctgcgtgttacaagagaggaaagaaactggtttgaaaccgattatccgaagattttagcagaagaaccaaagaaattagatggttctgaaagaggaaaagaacattgttcttatatcattgaggcattggaaaccggcaagaaatacagaggtcattttaacattatgaatgaaggctgtattacaaaccttccgtctgagagtgttgtagaagttccttgctatgtagatgggaatggaatcagtattccgaaagtaggcgaccttccactgggatgcgctgctgtttgctcacagtctatctgggtacaaaaacttgcggtagaagcagcagtacacggagatgtgaatctgttaaaacaggcagcattaatggacccgttaaccggagcagtttgcaatcctccagaagtatggcagatgattgatgaaatgttagttgcacaggaacagtggctgccacagtacaaagaaggaattgcacaggcgaaagaaaatcttgcaaaaggaaatctgattcctacaaaagaaggatataaaggtgcagttcgcttaaaagaaaaaacggtagaagaagtagcagcagaacatgataaaagaaaaatcactgcataagataagactatagttagagtcagacagtgtcaaaaagcgacactgtctgattttttataatataagagtaaagcgttcaatcaacaggtataataaaggtgctcatttaataaaaaacaaggactgaatttccaatattcacgaaattcagtcctcactttttacttactcaatttatacagttttgcatcatgggaatccactcccacaatcaactttccttctatttcacctaattctttttgcgcccataaatcacgcagtttataacttccagttaaatcaagcgcccgaaaatcaattgcgaaagtctcactccagtttgtcgtattaaacaccgcaagaaaaacatttccttcttcatcttctgcctgccatacaatcatgtctccctgacggattgcctgatgtgcattgcggcttgtctttaatagacttaacacttcttcatttgttaaaagtgcttttgtccattcatccatatccgtaagttcacagccaatcataagtggcgaacggaaaatattccacagagtgagcatagttcgttgttctgcctttgaaagtcttgtccatctgtcacttaatccatgttcacaacctctgatagaaatatgtccgaccggaagcatatcacaatccgggaaacagccttccgatacataaggtgcccagttattacatctgtcaaacatttccataatatcttcccaggaatcccagaagtcattggtgattctccaaagatttgcatattttcttaaatgctcggctttctctaccattgccggtcccggtgaaagacttaagacaatcgaccgtccacatttttcaatcgctctgtggagcatttcaatttcatccccgccatactgcaatgttccttcatcgttgatgcgaccatattttacacagatatcatccactttaatataatccactccccaggacgcatacaattccaaaatagaatcatagtattcctgtgcgccgggttgtgttgaatctacaccatacatatccgaattccaacagcaaattgaagctggatgtgcaacctgacgtgccgtataggaagttcctttaatcgtcacattttttgcaactgcctggcgcggaattcctctcataatatgaattccaaacttcaatcctttcccatgaatataatcggcaatctctcgaaatccctttcctcctgctgccgatggaaaacgattttcagccggaatcagtcttccatattcatccatacataaatccgcaaatttatgataatgactggaatccgctgtcggttcataccactgaatatcgcagatgatatactcccagccatatttcttcaaatgctctgccatataatccgcattttgctttaattctttttctgttaccgatgctccataacaatcccagctattccagcccatcggaggggtctttgcaaaatcatttttattcatacttttctccttctattttaagtcaatctcaaacaaacgcgcacatttttcctgtgggagttctacgcacaactcattctcatcataacagaatttacaatctacggtatccggatagatgaccgatactttttcaatttcttttccaaagtccagtggaatcttgacgtttgcagtttttggtgcaagcactgcaagatatactctatcctccgttttaattccgtaaaccagctgtttactttctaaatcagcaaatccaagcggaaaaatcggaacgccatcctttattccatcacgaatctgtttataaagtgcaattccttctgccataagtttaagattttcctcactcattttccataccattccacttatgtatggacgaagcaggagcccatttaccatgttataaatgacatgctctctatcatcttcataaggataaacccacatacccgcctgttccggtgttactgcacttgcaacatttactccaatataagaattgtaaatgtaatccgtctggtcactggtagactgaaggcttaaaagtttcatcattccataatccattctctgtccgccagaaccgcagttttcaattacaaggtcaggatgtgctttaaaaatttctttataccattgatataaacataaataatgctcatggattgcatcggaacagctgtcagaatttaactcacttccatatcccatcgtaacattataatccactttgaaatatccaactccataatcctcaatcagacggtctacaacttcacggcaatattttcgaacttccggatttctaaaatcaagtaaataccgtttattatcgatatgacgttttccatgacggcagatgaaccagttatctggaagtttctttgcaagttcacactctactcccatcacttcgatttcaagccagagtcccataaccagtcctttggattttgcatagtcgcagacagatttcattccgtttgggaaacgttccggtgactctttccattcgccaactctgtcccaccagtaccctttatcataccagccagcatccatacagtaatactcacagcccatctcagcagctttatcaatgatttctttttctgtactttcaatcgggtctcccatcagacagttcatataatcattaaatacaatatttaatttcttatcatcgtcattttctcttcggattgctctacgatactttgtcaattctgccattacttcattcaaagaaccatctgcaacaccaaatccaaccggtaccgtctcaaatgtgtctcctggttttaaattcttccaccagccattttccatctctgtcggaccgctaagcgcaagatacagattttttcccatagaagaaccatactctacaagccactgaccggaatgttcaatctggaagaaatacgtttcttttgcttctgtgtcttcacaaattcccatcggaagatattcacaacttgaccaggagcctcttcctccatagcagtatcggtttaacccaaatcccggagtgttaaatccatctaccatcattccatttaaattcaactgttttgcactgtcttttttccactgtgcttcacagcaccagctattatatggagtgtaaatctgtgttttatcataatatggaagtttcccatttgcacaaagaccatgataaacaaaagaagacacatactctaagccaactgcttctgtaccattattttttacttctgtccaaacctgtgctgctgaaatcccatcaaagaactgcatataataactaagttccacaccataatctgatttcgtatggatgattaactgctgacccttctctgctttttccaacgtatgatttacataatgaaactcttccgatgcactacttaaactatgtttatagccatgcatattcctgcttccttttccggtaagctgaatctctgtaatcgaataagatgcctgttcatctcttggttcacgatttctgtctggttttccagcggttgtaaattgttttaattcaacgattccattttcacgaatttcaaagataacttttaatccgttctcctcaatgcgaatttcttttgtctccataatcgtgttcctttctttttcctttcttttcttttttattttattaatcataataccaggcaccgtcttctgttttccttgcctgtttcatatatttttgtaagattttttccactaaaaatgaagaaacccaagcatatactccaggaacaattgccattaaaagcggaaacaaatagcaaatcattcctgctgctcccaaaagcagaatcagtaatattgtaattggaaaatatttcacggacatatgtaatgcatactgaaactgcccaacaatgctcatacgaaatcttgagagtacggaaaaaatatacagtactgtaactgcaaacggagaggcaagtaccattcccgatgcaacaaaaagatatggtgttctctcaaacattccactttttgtaactacacttacttgaactaccccaaccgactaacgtcggatggggattcctacgggctttcgcccgatacccactcgttcagctcatgggtgttccaacagagaacaaacccgttttcaggaatgtttttgtatgttggcgtaagtcagatattcccgtccatccagctccctgcccactcattcaactgactagtacaaaatgactggtaagaatatccgaatatttcttctatttctatatttttgtatttcgctttttctttcttctatcttcttttatacatactcatatcgattattttgcgtccattttttcatttccgatgcaatgctttttaaagttcctttttttctttcttctaagacttcataaggcagttcccggtaaaaactatggggcgaaactccacgaaatgcttttgttaaatgtttccatgctggaatgatactcacaatatctgttccattttttagtttttcttttgccttttctggtaataacataagtaaccgctcatccggtaacagtttttcccgaatttccattccttttaatccaatcgtatacgatgctgcttcatgaatggaaagtccaaatggtcttaaatacaaaaacttccccatttggctggtataagccggattcattttatagattccaaaactttgtttataggcttgattttccaaacagctcgtcatctttcggtaagcaaacaaagaagcatgtcgattctttttcttacatccatacttcattccgtgttttgcaagcgtggtatccaaatcttccataataagcggtttcttccgttcggcgcaataacgtcctacctttgccatcactcttccgatttcttctgaaatctgcccttttgttttcaattccggtgaaaagcgaatgactgtcccacccagacggtttcctttttcatctaattctgaaactgctacatggtcataattcaaatcaatcgaaacacagcctttttcaaaagattcattgcaatatttattttccagtaaaagcgtcaccgatacaatcagatatcttcgaccagttttctctcgtttcaactgaaaattataacaaatcgcttttcgttcctgtttttttgcctgaagcatttcttcccaaagttcctgttgccttgcaagatggaactttttaaataccgtttcttttccatccatacattttacaatcaaatttctttcttcttttctgaccagaaagttacagttttttgaagtatgacgtcctggaaggctcattgaagcatggcgagattcaaagaattcctgtttccactgttcacgatcgacttttggattgtcttttttttgatattgttttcttccaccaaatacaattctcttcggcagaaacttttttaaccattccagcctttgaatggctcttttcttagaagattccagtaatgcaattcttgttttcaatcgacgaatggaacgttctatttttctttcgtattcttcgactggaaagtatgttccattcggaagaaaaatttggtttcgttccattgtaattctacactttggataaggacgctcccagattccgcttttaaaataagttcgcaaagaagatttgattccctgcttcttttccaattcttcctgtgttcgttttatcttttgattccgtgtctcaatgtctttttcttttgttctctgatacaatcgattcaattccttttgagaagaaagaacagaagaagcataagtatagatggcacaattataatagtccgttgttccatagttccttttcagccaggagctgtatgtttcttctaataacggacctctttttaaaaaggatttgtcatacaagcagttatagagcttgattttgatatgattaaatcgttccatcgtctgaatcaaagactctacgttctggatttcatcctcatccagataataccgcttatctgcatttatcgttctggttaactgcatgaaaacactccttttctcaaaacagtttgtcggttgaaaatataacaataattgaaataatcctttatttatagtataattatagcacaaatcaagccgttttacaacatcggttattttaaagaaaggagaaatttatggacaacaaaacttataccagaaatgctcattccgtctgctgtctgacctatcatgctgtttttgtcattaaatatcgaagaaaagtaatcactccagaaatccttgcttttatgcgtagttacacagattacttaatttcacagcgttatcatggaaaacttttggaatttaatggtgaagaagaccacatccatatcctatttgaacttccgccatccgctgcaccttctgttattatctgtaatttaaagactcagctttcaaaggaagtccgaaaacgcttctgggaacaaattcacaatcaattatggaaagattctttttggagtgacagttacttcttatcgacaactggcggtgcaaatttggaagtattagaacaatacattcaacaacaaggaatcgaaaaacaaaaacggaaatacgttcatcacaagaaaaaatgagcattcatccccaaccgactcgtcggatggggatgaatgctctataatagataaaattacggcatataccagataaaatagtgttataccaattccctgctttaaattttctttaaaagaatgccagaaagcaattgtgacagtactatgttttttccttacaactttaacaattgtataataaagtgctgcacttgccggtcctatcgtaataatcggaatacatgctatcagccacaaaaatcctgcaattatcacttctgaaatctgttctgcgattgacacaatcggagagtcctctgataatttcaccctcattcctcctgttttttctcattactttattttatcatttttctaaaaaagctaccattggaatctatccaaaggtagctttttttactttttacttaatcgcactatctacctgaccttggataaaatatttttgcaggcacaggtaaacaataatcaatggtaacataccgattactgctgttgctgctgctgcaccataatcatttgatactgctgagaagaacgttttaatgaccaacgtaatggttctcatggatgtcttctgcaggaaataatatgcataagtatattcattccatacactaactccttgaaggataataactgttacagttacagttttaagctgtggtaaaataattttaaagaaaacctggaaattacttgctccatcaatggcagctgcttcatcaagcgcaaccggaattgatgaaataaagttcgtatacaagaagataacaagtagaagtccaaatgcacttatgttgttagacatctttttttctttttatagataaaatttaggggaggcagatgaaccgtttcgactcatctgcctcccctattagaactgtcattaaccgacagccccattctattacttcgaccaatatcttttgatcaaccgcaacatattttcacttctatacttccatttttttcatttcttccaggaaatcacgaatataagctactgctaaatctaaagcttcctgtcccaactcagctgaagattcctttggatcaaaaggaccaaaccaaccactcggtgcgatttctttagtatctcttacaagacgcacaattcctcccttaaaattgaccgcctgaatgtaagctgctttcatattttcggtcggatcttgagcattaatcggcttgctcagttccagatgcacagaatccggagcaattgccatcattgcagaagtttccagaacatcaccatgaccaccttcaaattttttgtctaactgagctaccagactccaccaatcaacgcttgcacatacaccacctttatgatagacttcaagcgctgcacgatcaatagacggtgtatttccgccatgaccatttaaaatcacaaagcgttttgctccatgctgcataagagaatccataataccatggagtaccaaatacaatccttcatatccgatattgatgcttccctcaaaactcaaatgatacgggcaaacaccatacggaacggttggtgctacaattacattttctacatcttccacgtgatctgccagataagacggaaccatgaaatctgttccaagcgcactctgtgtaccatgctgttccgtgcttcctaccggaatcacaataatcggatcttttaaaaaggcttcctttgcctgtactgttgtcatttttgcaagatacattctctaattcctcctatcatgctataccataaaatggcgttcaattgtctcctgtggcggagctttggtaaatttacttacaataaccattacaattgctgaaatgatcgttgttggaaacaatgcatggaatcccaaagcaagtgcttttaccgatggatttaaggtaaagagtaacaatgagatcacacctgttactactgctgcgattgctccctttgcagttgcttttttccaataaataccaaacaaaatcggtactacaaaaattgccattcctgagaatgcaaataagttaatttcaaagatactacctggctggaatacaccaaagcagattaccaaaataccaattataacggttattactttagaaagcttcataacactttcatctgtcgcatttttattaacgagtttttggtaaatatcacgggtaactgcaccggtagtcgttaccaaaataccatcgatggtagacatacctgcggctacaatgccggcaataaaaatagaagctaaaaatggattcaaacctctttgcaaaatcattggaacaatctgatctgctttctcaatattctgaattgtagcaattccgtttacaccggcccattcaatcagagttgcagagaaaaacatacctgcagtacccagaaggattgctttaaacattgttttatgatctttcattgcaaaaaacttagtaaacaaatgtggctgtcccattgtaaagaaggaccacaacacaatattcgatacataatatgtccaaggcatataaccatttgcacctggaaacgtcagataagcttcattcatactatggagcgtttgattgatattagagaaaccgcctcccattacgatagaaaccacaaatgtcacgattgcggtcgcaatcatcaaagaaccctggattacgtctgtcatcatagcaccctgcataccgccggtcatacagtacaagatcacaataattcccattccgacaacgcctacccattcaggcagtccggtaaatacatgtacaataacacctgctccgataatctgtgctcccatcatcggaatcaagaaaaacagcatcatgataccaagcacaccactcataactttcgagtcataacggtctgtcagataatctgccattgttaagaaaccatatttgtgtcccagcgtgattaacttacgaccaatcaaaagcgccggcaaaatcatgcaaaatactgcacccggtacagaaattgccattcctgcatatcctacgccataaattgttcccggagttccaaggaatgttcccatagaaaactgagtagagaaatatgcgataccactcactactactcctgcttttccgcttaagacaaagaaatctcccaagctgttggtcttgcgtcctgcataccaaccaataaatgccataattccaagataaagtaccaacaccgtataaaaaggaataggtgacggctgaattgctgctccattcataattactttttctcctcctcatcataggtgtgatattcttttcgtttcatacacatgcgataatattttataatcagcgcaaatgtaattgctgtgtgcacaaaccatccaaacaaaaaaagcggaatcccaccaaatgcagggatatatgtctcgctataaaagaatgggaacggaatcataaggattacaaacataaataagaaaataatcaaccaagtccgttcaaagtgctcttcaaactgctttttcatagttttgccctcctcttttttcaatttctttcagttaagcatatactttactttctgttttttattatacatgctataatagttttgtaaagtcatcacttacatttttgttaaatatcacgaaacttttttaaccctgacgacgaaaggaaactctatggacattttagaacatattcaggaattatatccaaatcttaccaaaaagcaaaaatcgatagcagattatttaactgctaaccctgaagaaatcagttacattactctagcgcaactcagtcagcaaactcaagtatctgaactaacgcttctgcgcttttgccaaaaacttggctgttctacctttgtaggtctaaaagaacagtttcgagattatacccagagaatgattcgtattgcttcctcctcttcttactttattccggaactggagaccggtgaagcacctgagcgagaacgcatacttttaaaaatttgcaatcatgaagcaagtgccttttccggctttatttctgatttacctttcgattccattatcgctgcttctgatgaaatccgtcgcagcaatcgaatttttatttttgctcacgatatttctaaagtacctggcgaatttttaaaatctcgactcctaattttgtattttaatgcaattttaattgatttatccgatttagaacaaacacaaaaaactttacgtcagcttaccaaaggagatcttgttatcttcttctcctttccacgctactattttccaattggaaatattgcaaaaaaagcctctgaagccggagttccgattttaacgattacggacagtgatgcctcacctgctgcttgctatagcaacttattgctcatttgtcctacctctacagagctgttttacaattcaatgacaattccaattgctatgctaaatattttagcatcctgccttgtcattgacattatttcaccagccgaacgacaaagttttatcgacacgttatcttcttaaactttttaaccaaatcaagtaagtcccctgcttcaattgtgaaaagcaataagcaggggtggggacttgcttgtatcatgagggggcaagtcccttctgataagctgcgtagcagctatttggttatgagcaagtagcaaagcggattgcgaatatccacttgactctctttaaaaaacggagacatcgattcaaaattccaaatcgatgtctccgtttttcattatttttcataagtgcctttttgaagaatctttccctctttcataaaaagctttccattagccacaaaagcatccaactgtaagtctttatcaaaaagaagaatatctccatctgcgccttcttttattaaacctttcttcggcaataaatcaagcccctctgctacctgactcgtcatataaggcaacgcctcctcaagcgacatttcaagttcttctatcatatactttaattccttataaagcgcatccacaccagaaacaccaatctccaaaagtgttccatcttctgcataattggaccaacttccatgaccatccgaactcatagtaatgtgctcggtagaaattcctctcctctttgcttctaatacacacttacccggagaggtgtgcataccgcaagtcaaatccacatatccgcctttttgcaagagttcatatccttcttccatcaaatttttattacgatttacatgcgtcggtctaaaaattcgcaccggaacagaacttgtgtccaatgcttgaaaaaccggctgcaaccctgccttgtcatctcccatatgaagtacaacgattcctggttttccgctaagcattcctgctactctagccttactggcaatctgaatcagctcgtcttctgtcacattcggtgcacgatgatctgaaatagcaagcttcacacccaaaatttcttttacaaacacaatatctctgtcgatttccccagtaatcgtcggatttggaatcccataagctccagtcagcatatatgcacttaccccttcttcacaaagtgctctggtttttgcatagagattctctacacttcttgtaattccatcggttcctaaaagccctactaccgtagtaattccattttctaccagctcagaaagctgcaattccggcgttcttgtatgaaaacttccttctccgcctccgcctgtgatgtgcacatgctgatcgatgaatcccggtgtcaaaacttttccttttgcatctaaaacttcacaatcaatcggcagcggaccaatttcgtcctgaatcttttcaatttttcctccacagatcagtacatctttttttcccaaatattttggcgcatatacttctgcattttttattaatagcatctcttaccctcatcttttctttttgcttttcacagttccaaggaacatgcatcaatttttttcaattcttcttcactaaatgatgcgctgtttaatactttcagattttcaagaatctgctccggacgggaagctccaattaaaacacttgttacaataccgtcacgcaaaatccattttaatgccatctgagcaagactctctcctctatctgccgaaatcgcatttagactgcgaatgctttccaaacgttcttgtgtaaactgcttcgcatgtaagaatcgtccatctgtatttacacggctatcttttggaatcccatttagatagcgatttgtaagcattccctgtgccagtggactaaaagagatcactccttttttctgctctgctgctgcttgctttaaaccatttttttcaatttctctgttaaaaatattataagaattctgattaataataaacggacaatgtagttcttctaaaatttttgccgcctgtttcattgtctcaccatcataattagaaattccgacatagagcgcttttccgcttctgacaatttgcgccaaagcttccatagattcttcaagtggagtttccggatccatgcagtgatgataaaagatatctacatattctaatcccatacgtttcagactctgatcgaggctggcaatcaaatatttccgactgcctcctgttccatacggtcctggccacatatcataacctgctttggtactgattacaagctcgtctctataagcataccactcatttttcaatattttaccaaaattttcctctgcacttcccggttgtggtccataattatttgcgagatcaaaatgtgtaattccatgattgaatgcagtaaaacacatctgtctcatattttcatagacgccagtatctccaaaattatgccataatcccaaagagagttccggaagcataagaccgctggtaccacagcgatgatatttcattgtttcatagcgtttttcgtttgcctgatacatctttcttctctcctgatttttactttactttatagtttatcaaaagatgaaagaaattgatagacgttttctgccgatatttttactttctctgctttctttataattctgctccgtttgtctctattacatgtttataccaaaatgctgagtctttcatgattcgtcgccaatacctttgccacctggtaatccacatcattttgatattgattattataacaataaaagattgcaacgaaatttaggagtattaactccaatagcaaaatacaaacaatatatgttggtagcataaaaaaactgccaccagattcaaaactggtggcagaaataactttttatttttttaattgtctacttgacgggaagcagttcaatctctgctctttacactgtcttttcttctgcctttactatgcccttaaatatagttttaatgtcctttcaaattactttcttatcaggcattagcaaaaggagctccttttttgtttttacatatccaaatgcactgcaccagtctggcgaatctgcatcacataaatattttcttctcccatataaggagtcatcatctccacatatttcggtgttaaatcttttggaagcactgctgcaatgacacctgcaaatccaccgccatgaactcggcagtatcctcttccttcttcttcgataaataattcggtcagcgcaagtgcaaccggaactgcctgttctgtctcatcttttgttgcaaagcagttctgtaaccatttccaggaggaatttcctgattttgtaatgcagcttaagaaggttgcataatcttcttctttgattgcttttactgcagtatctactcttttttgttctgcaaagaaatgcagggcacgcattactgcacgatcaccggcttcttctcttactttattaagatttgccataaattctttttcgtccacatccgcaagcacttcttttccaaatacctttgcggcacgtttcatttcaaccggcactgcggaatattcttcacttaagtctgcatgaccttttcctgtatttacaataattaagtcatatcctaacttatcataaccgaattccactttttctacttttggcatttcctctttgaaatcaatcgcaatgactccgcctactgcacatgccatctggtctaacagtccggactgttttaaccaatattcatgttctgcatactgtccgattttcgcatattcaacataatcaatttttccttcattgctgaagtagttcatgattgcgcaaatcagcatttcaaaagacgcagatgaactgacaccggctgcaccgattacctctgttgtgatataagcatcaaatccttctactttgtatcctttttttatggcacattcaaacataccgattaataaagataaggttcctttgcatttacattcagaatccagattttccaaatcaatggtaattgctttgtatccctcactgattacatgaaccagagaagttccgttttttcttgctgctgcaatggtatccattgcaatgcttgcagttaatacttttccatgattatggtcggtatgatttccaagaatctcggttcttcccggtgcactgaagaaatccacttctccctcgccaaaacattctttaaattttgttgccagatgttcatatcttgcctgttccttcgctaagttttcttctccataaacactgctcagtacgcttacttctttttctgattcaaacattcccatttttttaccttcctttattgtatttttcttttctttacgttcacacttgtaagttttgttacttgtattataatggagttatagacactaatacaaggaatatcatggggattatatggaggatattgagattttatgcaaatacagacgaatcgaaaccagagggaattaaaaagccatggagatgtttctttcccgattctggtcagccatgagagcatcacatcttatgagttaaataccttttcctggcactggcatcctgaaatcgaattaacattaattgaagagggcgaaatgatgtatcagattaacggacatgaaatgcatgtccaaaaaggagacctactgttttccaactgcaatgctctgcacagcggtcactccattgacggaagagcctgctactactggagtattacttttgattcaaaattaatttatggatttgaaaacagtctgattcagaccaaatatgtcgatgccgttgtaagtgcaaaagaattttcctctcttttattggatggcagtgaatcctggcatcacgatttaaaagaactggtctgtgaattgatctccctttcctccgataaatccgatttttatgaaatcaaaattcaaatgcagcttacaaaaatctggctgatgctcctcgaacacagaacctcattttctttaaatgaaaatgctctgaatccgaaaacatcagccagattaaaagccatcttaagttttattcacgaaaattttgaaaagaaaatctctctcgatgatattgccaactcggttcatttatgtaaaagcgaatgttgccgtttttttaaaaaacacatgcaggaatcactttttgattatcttctgcgttaccgaattgaacaaagcattccttatcttaggaaccctgaatattctatcaccgaagcagctctttgctgtggctttagtgacgccggatactattcccgcatgttcaaacgctataccggaatgtccccaagagattaccggattggtctgtttccggattacgacaggtaacccctcatatgtcattattttctttcctacactttgtaggaaaactttgaatttttccccactttctgcggcttgttatttctctctaccctgctaaaataataaatataaaaagcaggaaacgaaagggaaatccttaattatattgtttcaggaggtgtttcatttgattattattggggaaaaaatcaatggttccattccatctgtagcaaaggcaatcgcagaacgtgattccgaatttatcaaagaacgcgcaagaaaacaggctgctgcaaatgccacatatattgattgttgtgcatctgttccggaagccgaagaagtagaaactttaaaatggatgattgactgcatccaggaagtaaccgatttaccgatttctgttgacagtccaagcgctgacgttttaacgcaggcatataaattctgcaaacgtcccggaatctttaattctgtatccggagagggcgataaaattgacaaaatctttcctcttatggcacaggaagaaaacaaagactggcaagttatcgcactgttaagtgatgataccggtatcccaaaatgtgcagccgaccgtcttcgtgtctttgacaaaatcatggcaaaagccaaagagtataatattaatccgagccgaattcatatcgacccgttagttgaaatgctttgtacttcagaagacggaattgcaatgaatatcgaagtcatacaaactgtccgaaaacagtatccatcaattcatattacagcagctgtcagcaacatttcttttaatcttccggttcgtaaactgattaactacggatttttaattcttgcaatgaatgcaggtcttgacagtgctattatggacccaaccaatcgtgacatgttaggtcttacttatgcaaccgaagctttgcttggcgaagatgaattttgtatggaatacatcggagcgtacagagaaggcttaattggtccattaccaaaggcttaactctaaacatttgaaaatatattggaaatttaattcaatcgaaataatagggaggtatcactatgagtaaacttcaagatgttgaaaatgcagttgtttccggaaaatctaaattagttgcaggtcttgttcaggaagccttagacgaaggatgttccgctcctgatattttaaatggaatgattaatgcaatgggtatcgtcggtgaacgtttcaaaaaaaatgaaatctttgtacctgaaatgcttgtcgcagcacgtgcaatgaaaaaaggcgtcgatgtattaaaacctcatcttgcttccggaagcgctggtgtttgtggaaaagcaattattggaactgttgccggtgaccttcatgatatcggaaaaaatctggttgccatgatgattgaaagtgctggatttgaagtcattgacctcggagttgacgttccggttgaaaaattcatcgaaaccgttaaagcaaatccagatgttaaaattgtcggatgttctgcacttcttaccacaaccatgcctgcattaaaatctacagtagaagccttaaatgcagaagacttccgctctcacattaaagttatggttggaggtgctcctatcactcaggaatttgcaaatgaaatcggcgcagatgcttacacaccggatgctgcaagtgctgcacagaaggcaaaagaactggtagcttaatttctatttgatgtttgtcatttttaatccttacactttaccaaaagaggctatgtactttcatggcctctttttctacttttactgcctagatagatttactgtttttttaatttctgctataattgatacaaaatgcacgacaatttcaaccttatttattattttgacatttattgggggaattttattgaaactttttaacattcactttatcaatgaaaatcaagtaatccaggtaccagaaaatacaaccctgttagaagctgaaatcaaagcaggacttataccggatgccccctgcggaggtcagggcacttgcggaaaatgtctggttcagataagagttcaggaaaaatccgaacttgtaaaagcctgccagacaaaagttcattcagacatagaaatagaaactctgaaacatacttcaaagcattccattctccatgaaggtttttcccgtccggttcttttaaaacctgccctctcctgtcatgcaatcaaattagaaaaagcaaaacccggagaaaatgcttctgactggcagcgccttactactgcactcacaaaggtttccgcaactgacatgagataccttgaacctgacttgacctttgtttcacaaatttatacgttgcaaaaagagaagatttatgccgtaacccttaagaaccatctgcttgatttaaaaaatgctcctgtcattccttatggtgcagcttttgatattggaactacaaccgtggtcggctatcttattaatctgaccacgggaaaagtttgcgctgttgcaagcaccatgaatccgcaggttcaattcggtgcggatgttatcatgcgtgcaaactatgcattagaacacggaaccaaagaattaagcagttgtatccagactgccattaacaaactgattggacagcttacaaaagaagcagagattgaacgaaatcttatttatcaggtcatcattgccggaaatacctgtatgcaccatctgtttcttggaatttctccggcatctctggttcatgcaccatacaatccggcagtcagtcagatgcttgatttaaaagcctctgatttttctctttctattcatccaaacggacgccttatcatgttaccggatattgcaggatttgtgggagctgacaccatcggctgtctgctctgtgtccgcccggatttaaaagaagaaatcacactcaccatcgatatcggaaccaacggtgaaatggttcttggaaatagagaacatctcgtcacctgttctactgctgccggacctgcttttgaaggtgctaaaattgagtgcggcatgcgtggcgctgctggtgccgttgaccatgtacactttgaaaacggtgattggaaatacacgacaattgaaaatgaaaaacccgtcggtctctgtggttccggattgattgatttgactgccgaactgttaaagaatcatctaattgattcttccggaaaattcatccagtccaaatcttcttttactttaattgaaccagatgaaagccggaattttaacggtgtctatctgacccagaaagatatccgcgaagtacagcttgcaaaggctgccattgcagccggaattgaaagtctggaacaggaacttggaatcaccgaagaccagatttccaaagtatacatagccggagcctttggaaattatatgaatccacaaagtgcctgtgaaatcggaatgattccatttcacttaaaagataaaatcgttccagttggaaatgctgcaggagaaggtgcaaaaatcgcattgattaacgaagaggaacttttatacgcagacaaacttgctaaaaagatttcattcgttgaacttgccgcatcggaagattttcaggactgctttgtcgacaatctggaatttcctgatttttcttaacacatatatgctctcggaatctttatctttgccgataagactccgagagtacataaatcgaatagaggtgtatctctcatgattaattacaaagaattagaagatatcggtcacaaaacgggatttacccacattgtaccccttgactgtaagaccattgaacttttacctgaagtccgtcagatgtgtcaggctgatacctgtcacatgtatgagaaaaactggagctgtccgcccggatgcggaagtttagaggaatgtcgtcaaattatcgggcgctacacccacggaattattgttcagacagtcggggacttagaagacgagcttgatggtgaaggcatgatggaaactgaacatcagcataaatctcatttttatgaaatggaaaaaatattaaggcaggtctggccggatatgctcgctgtcggagccggatgctgtacgaaatgcaagacctgcacctatccggatgctccctgccgttttcctggaaaatcattttcttccatggaagcctacggcatgcttgtcactcagatttgcgagagaaatcatttaaaatactattacgggtcctgcaccatcgcttacaccagctgttatctgctagagtgaacttaatacacaaacacaggaggaatttttatgactacacttgaactgctaaaagaggccatcgaagtcggacatccccgtgatgcacaggctcttgtctaccaatgtctcgaagagggcctctcctcctcggaaatcattgaccaggcaatgattccggcaatgaaatcagccggagaatactacaaaaataatgatgctgatatcccgcggattttatctgctgccagaagtgtgagaaaagcctatgatattttgcaggaaaaattcggttctctggaggatgaatcgcttggaaccattattcttggaactgtagaaggagatttacacgatgttggcaaaaatctggttgctttgatgtttcgaagtgccggattcaaagtaatagaccttggcgtcgatatttccgaaaaacaatttttaaaagccgtaaaagaaaatccggatgcctctatcgtctgcatttcttctctgcttaccactgcactgcctgaaatgcaacaggtcgtaaaatcattaagaaaacatgacccaaaacataaactaaaaattatggttggcggcggcgctgtaaccgaagaacttgcaaaacaatttggagctgacgcatatagcgacagtgccatagaagctgccgaaaaagcaaaaacttttattatttaacaagcaacggagcttaaattttatgaaattatctactgaacttctttttgaaaaattacagaccgaatttacaataaccgcttacagaaatttatcaagtgcggatggatttttgcgcccttttttatatgattccaaaccgcttatcgattcccgaccgatttatgaacccctcgataaatccaaaggaatcactccgggacacgtctgccttgcccacggaaaacgcttagaagaatttattcctcatatttttgaagaacattttttagttttaaccggtaccaggggcgacgttcaaaaactttcttctgctgtctttccttatgtcgttctttctgaaaatacctctttaagcagtgttttaaattttctgcaggacatctttgatttttatgatgactggagtaacgaattaaatacttttttattaaaaaatgatgatattactctgcttcttcacaatgctctcaaaatttttcaaaatccactttctgtaatcagcgtggatttttccctgattgccgagaccggagaagaaaaaatcccggaaaaatccagaattttttcagataaagaaccaaatattgattacatcaatgcgcttacacaggacgagacctatcagtctttctgtaacagtccgactccgtttttctttccaggatatatcacaggaatttctactctcaccatgaacatttttcaaaatggagttcctacccaccggcttatcctctatgaagcacaaaaacccattaccaggggcgaatattgtctgctctcccatcttgccggttatgttgaatatctgctctatcatcagcatattccgatttccggacaggcaaatgatttgcatcgtattcttcagacaacactttctgatagaagtgcagactatctcgatatcagtcatcagctttcttctcttggctggaacacccggcatgaatatctctgccttgtctatcagaccacctatcttgaccagaaaaatatgactacacgcgccatctgtaattacatggaaaatcattttccggactgctcttcttttttatttaaagatgaaattgtcacattttttaatctttcacttttacatgcaggcagtgatgaaattgcttcaaaactgacttattttatccgagacagtttcttaaaagccggatacagccgtgccatgaccggacacatgaatctaagacgtcagtatgtgcaggcgaaaacagcacttgatgtcggcagtcgaaaaaaaccttatgtatggattcatcattttaacaatatcgctctcccttatattttagagcaatgtacccgccgacttcccgcttctatgatttgctatgaaaatctgttaaaactccaggcacttgaccaggaacaaaactcggaatatgtgctgactttaaaaacctatctcgaacaaaatttaaatgccacgcagactgcaaatgaactttttatccacagaagtacgtttctctaccggcttgagaaaataaaatctattttagattctaatttagacgaccccgacgagattttttacctgaatctctctcttcgtctgctcgaacaggaagcagaaaaaaattaatgatccagatactttttttcttctcttcgataaatcgagagttccacatacagcctggatgcaaaatcatccaggtctaattttgtcagctccttgattcgttctaaccgattcaaaaatgtgctcctgtgaataaacagttcttttgccgtatgagccgcattataacgacatttcacataacattccaatgtcttataatactgtgtccccatctgtctgtcatgctccatcagcttttgcagtgccagggaatctacttcttccgaaagaaattcctccgctccatgcatcatcagatacatcaatgcatactcatcaaaccgataattccactgttccggatttctcttcatccccagttcaaatcctatctccgtctgtctgaccgcagacataaagcgttctgtcttggtaaattcacggctcgatgcggcagtcagcagattctctctcaaaaaataagcaaggtctgactgaaaatccaccattggacttcttgaagtatttaacaaaacatacagacctctatctgcaatcacacagcatgtatctttccatctgcgttccatttccggacaaagataacgttcaaataattccctgtctcgtctgcatttagaacgaagctcaatcaaacagaaatgttccccttttttccatccaacattttcaaatgcaacgtcccacttcttctccggacagctttttccatccagacattgtttcatcacccgatgtaattcatccattgacacatccgattgattaaaagaaccataacgtgcatacattttttctacataatctgcaagcagttccaataaatccttatgataatcgttttgcagtggagaactcgaagaaagtgctgtaagttttcctacataagccccttcaaaaaaaatgttcttacataaataagttccctgttctaaactataactatatacaccttttaatttaatggtgttttcataagaaaaatcacagataaactcactgacaaattttaaatccaatgcattttgagaatttttgaatggtacaaaatatccatctctgtccacggctgcaacataaacaaacttctcatctgtcagtgccaccggtgtttcaaaaatcttttcacagcaactcatcaagtgtgtaaaatcaagattttccataaacacatctataaccgatttttcaaacttttcaaaataaaaaaagatttcctgaagccggttgaaaacttcctctctttccacttctttatccagtatgattaaatctctatctgtcctgcaaaatatagtgtctacctctccaaaacagataaaaacacaatctttaagcgcaggagattttagcgcaattttctcaaatttctcattctccactaatacgatatgtcccgaaagattttctccttcccggtaataaagtggcttttctacaagaattttctttggattacaggaaattctgcgaatcgaaaataacttttttagatgataataaatttcgttaaatgtaagcttcatagtacatttcctccatactacaaagtgtagtgtcacaccctctaaaagtcaattatttcatcggatttacgatttcataaattcctgctatgataaaactatcttaagagaacgaagtcaaaaagtaaaaaaagaataacgaacgtaacaaataaaggaggtttttttatgttaactaaacgtcagaacttattagaaaccatccatggcggaaaaccagaccgctatgtgaatcagtatgaagcatttgctatgttattcaacaacccacacagcatgcatgaccctgctccggaatatggaaaaccaccggttaaaaatgcatggggtatcacaaaagtatggccggaaggcacacctggcgcattcccgattcatgatgaagaacacattgtatgtaaagatattacaaaatggcgtgaaactgttcatgcaccacgtctggattattccgatgccgagtgggaaccttttatcaaagaagcagaaaaaatcgaccgaaatgaatattttgtgacacagtttattgctcccggaatttttgaacaatgtcattatcttcaggaaatccagaatgcattaattaatttttatgaagaaccggaatatactcaggaattaattgattacttaacagaatgggaactcgaatatgcagaaaaaatctgtaaatatattaaaccggatgcactcttccatcacgatgactggggaagccagaattctacttttatttctcctgatatgtttgaagaatttattctgccatcctacaaaaaaatttacggctattataaatctcatggtgttgagctaatcgtacaccactccgattcttatgcggcaactttagttccttacatgattgatatgggaatcgatatctggcagggaaccatgagctccaacaatattccagaattaatccaaaaatacggagacaaaattaccatcatgggtggaattgacagtgcctctgttgaccgtccggattggacaccggaactggttgaaaaagaagtacgtcgtgtctgcgaagaaaacggtacaaaattctttattccttgtatcacacagggtcttggaatcagtaccttccctggtgtatacgagacagcaagcgaagtaattgataaaatcagtaaagaaaaattctaatctcttctctataccaaaaggacgaagcttcaaaagctccgtccttttttcgatacagatcatcaaacgatatcaacttaaatcggcatatttgcaataaataaatacatcacaataaaatggcagatacttccccccatcacaaacagatggaaaatttcatgagagccgaaatttttatgctttgcattaaataacggtactttgagtgcataaatcactccaccaacagtataaatgattccacctgccaacagccagccaaatcctgccggattgagtgcttttacaatcggaataaaagcaaatacacacaaccagcccattgcgatataaatcacagaagaaaaccattttggacaggtaatccagcatgccttcacaatcgttccaactattgctactgaccataccgcaatacaaagaatcgttcctgtttttccatgaagtgcaatcaggcagacaggagtatagcttccggcaattagaaagaaaatcataatgtgatccatttttctaagtctgcggtttactttctcagttgaatccactgtgtgataaattgtactcgctgcatacaacagaatcatactcagaataaaaatgctcatcgcaatcaggtgaatcttatccggttctcttgctgcctttaaaagcagcggggcagccgcaagtactgccatcacacatgcaataaaatgagtaattgcacttccagggtcttttattttaaatttcatacaaaacactcctctctattctgcaaaattatatgattagtattgtttattattttatgtagttttaattactacttgttatgaaatataatactacttattttctctttttgcaagtgatttttgagagaagtaatcgacttattttgacaaaacagaagttttaacaaaaaaagaagtacgaattgaagaatttcttcattccgtacttctttttttattacttcttatttcaggcttataaattatccaaagtatctctttaacagaccagcaaatgcttttccgtggcgagcttcatcttttgccatttcatgaacagtatcatggattgcatctaagtttgctgcttttgcacgttttgccaggtcaaatttaccggctgtagcaccattttctgctgcaacacgcatttccaggtttttctttgtgctgtctgttacaacttcacctaataattcagcgaattttgctgcatgttctgcttcttcgtaagctgctttttcccagtataaaccgatttccggatatccttctctatgagcaactcttgccatagccaggtacataccaacttcagaacattcaccttcaaagtttgctcttaaatctgctaagatatcttcgcttacgccttttgcaacaccaactacgtgttctgctgcccagctcatttcgtcttctttctgttctacaaatttgtcagcgccaacgccacatactggacatttttccggtgctgcttcgccttcataaacatatccacatacactacatacaaattttttcataactgttttctccttttttaatttgataatttatttttagatttttaataacaataattattactgttttaatataacatacttgactttttttgtcaactagtttttttcttttttaattcctgacttttgttttccagacactccttacagattccataaaatgtagttctatgtccgtggatttcaccatcaaagtttttggcaatccgttctgtaagacctgtcagatgctcatcttcaatatcaaaaatattatggcatctggtacagatgaaatgactatgcggttttgcatttccatcaaagcgatccggtccgtctcctgtcggaacttttacaatttcatctaattccactaagagcgaaagatttctatataccgtgccaagactgatattgggatactctttacgaattgacgcatatacatcatcagcagtcggatgctcttttgaggcttttacaaactctcgaatggattccctctgacggctgtatttcaatgtagccatcgcatttcataccccctttaattcttactttaataacagtaattgttactgtgattaaaatatatcatacttaacaattttagtcaagtatgtttttaaaatttttttcaattaatttaagcttgtcctttcttgcaagctgtttgatttcccactctcttttcattgcttcctgcctggtcaaaaatctttcataatagaccagctctaccgggcgtcttgcccttgtatactttgcgccttttccggcattatgattctgaatccgcttctccagattatttgtccaccctgtataaagactgtcatccttacaccttaaaatatacgtatagttggcactctcctgattttccatttcacaaattccttttatgtaatgggcactgacaaaacagcacccttctatttttaagccgccgattttaagaagtatttcactcaaaaaattttcacttttttatagtctaaattgaatcggctgcggattttcttttccgcatactttattatactcctctgtgcttcaaatgtgaatctttacacggtatttcctgttctgtttttatggcagatattccagcgggtcaaccgatactccatcctttgtcattgcaaaatataaattagaaccttctttgctgtagtacttcgtcggttcactcacataacccaatgttgctccggcttccatatagctttccggctcaaatgccgtatcttttaactgcccataaactgcctgatagccattccccaaatcaacagtcatggtaagtccggtttcttcgttatttacaacagaaacaacctttccatttgcaactgcaagcaccggtgttcccacgcctgccccaactgcaattgccggactgtagcggtattcatttaacgtcggaaaataaatcgtatgatccatgttataatccaaaagcacctgtccttctaccggccactgcatcagcgaactttccgtaaaattcacttccggtattgattgcacagcttctgtctgagtttcaacagactcttcttcctttatttgtgtttctatattttgctctgcctcgtctgtattttccgcttcttccggttcttctgtttcttcttccattactctttctccctctacctgtgaagtatttacatcctgtgtttctggatccttcgattctggattctgtgtttctgaattccggttttcttccgtagtttctttttcctctgttttcattgcctcatcaatggaatcgccctcatttaagacaaattctttttcatttggtacatttttacttccggactgataaaccaccgtacaagtacctgcaattactgccatcagcatcagtcctaaagcaagatgggttctgttttttcttctcatattttcacctcaacctatatggagcatccgccccttcttgttttcatctataggattgccaaaatatgagaagttattcatttttttgcatctctacttctattaattccaaacccggaaaaaaatagtttaaaatttcctgatactgcttgttttcctccgccatttttccagccgtccactggctgagtcccagtccatgtccgactcccctgcataaaaaacgaatcatttccttatctgtctgtacaataaaacaggaagaaggaagctttagaagttcacgcatttcttccccttgaaagtcctgattccctgcctgaatctccaacacataccccaaacgatctgtttctttgattttaatctccccggcatctttaatttcaaatcctgcatattctttttttattaatctgcgaaactcttttaactcaaaataacatccattgacataaaatggactcttcttatcctgaatcgtgtctacagaaatcaaataagcaaaattttcacccagaagttcctttccatctctgcttcgttctgttcccactgcataaaatggaatctgttttacctcatgattcaaagccagcacttttcctctcgtttcctctgctgattctaaaaatacatgaaatcgctctaaaaaaaatggaattcttcttttcgcttttaaatattttgctgcctcttctgctttctgcttttcttctcctttttcccactgcagataaaaatttccacgtgcaatcacagtctgcgccttaatgctctccttcggagcctcccagtctatctgcattgccgttaaaactgctatataatcttcaaaatccgtttcatttctgaccggtggacattctttgattcccaatatcaaggcaacaatcaaacaaggaagccctgccataaaaaataaaaggcatactccggattttattttctttttcataaatttataaaacccagacctcttttgtttattcttatgacaaaacttccctgtcctattcatattcttataatttcaaaatttaactaagcctcattatttttttataatcagtaccggaatcggtggattatttttgcggttgtaataagcactcacaatcaccagatattttttttcatcaaggctctttaaatacgctaaaagtgtatccctttcctcaaatccggtctctcctccgctgtaaatacaaagactcatcactccaccttttttaagcagtctcagaccctctataacggcgtttttactgctttcaggcttcgtagcaagagaatggtcacttcccggcaaatatccgaaattaaagcaaataccgtccacagaagcctcatctgcatactttgccatattttcatgactgtccagtatcaatcttgccttctgctccatcccctctgattttaataatgctcttgttgattcaagtgcctgcttctgaatatcaaatgcaagcacctgtccctctttccctgcaagctcgcataaaaacagcgtatcgtgtccatttcccattgttgcatcaatatacgttccgcctgtcactgcctgcattaaaaacaattcatgacaccattcggttatctgaaatgatttcataatgtcttactttcctccaatgcctgtgcaaggtcatcgataatgtcttctacattttcaattccgacagaaagacgaatcaatcccggagaaattcctgctgccttgagctgttcatcatttaactgtctgtgagtatgacttgccgggtgtaaaacacttgtctttgcatctgcaacgtgtgtcacaatagatgccagttttaagctgtccataaatttaacagccgcttctcttcctgcttttaattcaaatgaaatgactccgcaagttccttttggcatgtactttttcgccagttcatgatatttatcatttggaagtcccgcataatttacatgaccgactaactcatgcgcatctaaaaattctgcaactttctgcgcattataacaatgtctctccacacgaagcggaagtgattccagacttgcatttaataaaaagcagttcatcggagacggaattgaacctaaatcacgcattaactgtgcattaatttttgcaatgtaagcagattttccaaaatgctctgtatacacaataccatgataagattcatccggtcttgtcagcccatggaatttttctccataagcgtcccagtcaaactttccactgtcaataattgcaccaccaacctgcattgcatgtccatccatatattttgtcgtagaatgagtgacaatgtctgcgccccattcaaacggtttacaatttaccggagtagcaaatgtattatctacaataagcgggactccatgttcatgcgcaagttttgccattttttcaatatcaagcacaaccaatgcaggattggaaattgtctctgaaaaaacagctttcgtatttggctgaaatgctttttctaattcttctgccggtgcatccgcatctataaaagtacattcgattcccattttctttgctgttacgccaagcagattcaaggttccgccataaattgcagaagcacaaatcacatggtctccggcttcgcagatattaaagaccgcataaaagtttgccgcctgtccggatgaagttaaaactccggccactccgccttccagatctgtaattttctccgctaccatatcatttgtcggattctgaagtctggtataaaaatatccttcatcctttaaatcaaataagcgtcccatttcttcagatgtatcatatttaaatgttgtgctttggtaaatcggcatcattctcggttcgcctttccttggtttccaaccggaatgtaagcattttgtttcgatgtgcagctcttttcccatttctcatatcgcctttcttggtattatatttcttttattgtaccactttcagacatatcctgccactgacatcttatttttctcttaatcttacacagttatcgacaattatcgacgaaacttcttctgtccatagacaatcagacctacaaatacaacgattccaattgcaagaattatcagcttatttccgctgtctaatttattcatggaatctaaaaatccaagcaccatcatatcaatgccgataactgcaattgcaccacctgttgccatcataaattttctttcgttctccggtgacacaccttttgaaaatctctcacgaatcatacttggctttccccagataacaagatataaaccaatcactacaactactgcagctaaaataatcatcatcagacaatctcctctcattttcgctcactccttcccttatagtatatataagactcaaaaagtattttgaccctaacatcataatactgtaaaattaatatcaagtaaagaaaatataagaccaacgaaaggattgcctgattatgaaagaacaaatttataccattcctttaatggatgcttttaatgccggtgatgagtgcccattctgctttatcgaaagaaatctggaacagcatgccatggattttgtacttggcgccggtgcttcttatatggaagatgatatccgtgccgaaaccgataaagcaggattttgccgtgaacattataaaaagatgtttgaatatggaaaccgcttaggatgcggtctgattttaaccactcatttcaaaaagaaaaacgaagaattaaagcaacagataaaaatgttttctcctgcaaaagcttctatgttcagccattttaaaaaggctcagtctaccacggatgctccaaaaacttctatcggtgtctgggcaaaagcacagcaggaaagctgctatatctgtgactattataaaaatacttattcgcgctacctcgatacgttctttgaactctatcgaaaaaatcctgaatttgtcgagcttttcaaaaaaagtaaaggattctgtctcccgcattttgctgatttagtcgaaaatgcagaaacaattttatcagacaaagaaaaatcggatttttatgaaacgttattcccactgatgaccgaaaacatgcagcgtgtcactgacgaccttgaatggttctgtgacaaattcgattataagaataaagatgcagattggaaaacttcaaaagatgcaattccaagaggaatgcaaaaagctgctggcagctatccagcagatccgccatacaaatcggctttatagaattttagatgctctggcaacgtagtttccgagcagttcagaaatgacacgcaaaaaaacaagagccttgaatcttgaggggggatagattcaaggctcttatttttcacgtctactttataaaaaagaaggagagccgatataagggaaatatcggcatatgaaaaagaaaaagatttttgaaaaaagtcttattggctttgttcaagtaataatatacacagaaattgtgatgattttgtgttcaaataatgaaagaaatatgaaaaagtattttatactttttttatgaattggtattaccgatttgttttttgcttcttttagcgcatgagatgcaattttccttgcaaaaacgcaacaaaaaaagattgaaacctcttatcaagatttcaatcttttaagcagtgaagcatcggggattcgaaccccggacaacttgattaaaagtcaagtgctctaccgactgagctaatgctccatatttcaataatttcatcctgactattcgcaggaaaaatgcccagagccggaatcgaaccagcgacacgaggattttcagtcctctgctctaccaactgagctatctgggcctaataaaattaaattgagtagcggggacaggatttgaacctgtgaccttcgggttatgagcccgacgagcttccagactgctccaccccgcgttattaatttaaaagccgatgatcggactcgaaccgataacctgctgattacaaatcagctgctctgccaattgagccacatcggcataaatcaatgaatagaatcgcacctcatcggtactttcaatgggcgatggtggattcgaaccaccgaaggcgttgccagcagatttacagtctgtcccctttggccactcgggaaatcgcccatattaatttttaaaataaatgggacctacagggctcgaacctgtgaccctctgcttgtaaggcagatgctctcccagctgagctaagatcccattattcttttcgtttcctttcggaaacaacgacccagaagagactcgaactctcgacctccgccgtgacagggcggcgctctaaccaactgagccactgggccttatgaagaatatatcttcaaaactacatatacaaaaccgaaaccatgcagacacttgccgctccactgatttctcagtttctggtcaagccctcgaccgattagtagcagtcagctccatacattgctgcacttccacctctgccctatctacctcgtcgtcttcaaggggtcttacttcctaagaatgggatatctcatcttgaggggggcttcacgcttagatgccttcagcgtttatcccttccaggcttggctactctgccatgcagttggcactacaacagatacaccagcggcctgtccatcccggtcctctcgtactaaggacagctcctctcaaatatcctacgcccacgccggatagggaccgaactgtctcacgacgttctgaacccagctcgcgtaccgctttaatgggcgaacagcccaacccttgggacctactacagccccaggatgcgatgagccgacatcgaggtgccaaaccactccgtcgatgtgaactcttgggagtgataagcctgttatccccagggtagcttttatccgttgagcgatggcattcccacttaataccaccggatcactaagccctactttcgtacctgctccacccgtcggtgtcgcagtcaagctcccttctgcctttgcactcttcgaatggtttccgtccattctgagggaacctttgggcgcctccgataccctttcggaggcgaccgccccagtcaaactccccgcctggcattgtcccaccgccgggtcacggcggctggttagaaacccaatactgcaagggtggtatcccaacatcgactccgtagcaactggcgtcactacctcacagtctcccacctatcctgtacatgcaataccgaatcccagtaccaaactggagtaaagctccatggggtctttccgtcctggcgcaggtaaccagcatcttcactggtacttcaatttcaccggatgcattgccgagacagcgctcaaatcattacgcctttcgtgcgggtcggaacttacccgacaaggaatttcgctaccttaggaccgttatagttacggccgccgtttactggggcttaaattcaatgcttcgtttcctgacatctcctcttaaccttccagcaccgggcaggcgtcagcccatatacctcacctttcggtttcgcatagacctgtgtttttgctaaacagttgcttgagcctattctctgcggcccgcttttacacgggcaccccttctcccgaagttacggggtcattttgccgagttccttggcaatgcttcttccgtcggccttaggattctctcctcatccacctgtgtcggtttacggtacgggtacgttacaaacaatagcggcttttcttgacgcatggctcacacacttccctactctagttcggtccgcatcacgcctttggattgccacacggtttttcctatgtgactcctccttcgcttgccctgggattccattcccaggatgtgctttccacacgtgtccccacagttctgttctaacgcagtacaggaatctcaacctgttgtccatcggctacgtctttcgacctcgccttaggtcccgacttacccagggcagatcagctttaccctggaaaccttagatattcggccataaggattctcaccttattctcgctactcattccggcattctctcttcaatacagtccacagctcctttcggtactgcttcttcccgtattcaatgctcctctaccaatgtatcaaatacattcctcagcttcggtgtcgtgttttagccccggacattttcggcgcaggacctctcgaccagtgagctattacgcactctttgaatgtatggctgcttctgagccaacatcctggttgtcttcgaaatcccacatccttttccacttaacacgtactttgggaccttagctggaggtctgggctctttcccttttgactatccaacttatctcgtatagtctgactcccgataatcaattccatggcattcggagtttgatattcttcggtaggctttgacgccccctaggaaattcagtgctctacctccatgtatctctatcgaggctagccctaaagctatttcgaggagaaccagctatctccgggttcgattggaatttctcccctatccacacctcatccccacccttttcaacggatgtgggttcggtcctccactgcctcttacggcagcttcaacctggacatggatagatcacccggtttcgggtctgcacatactgactctggccctattcagacttggtttccctacggctccacgcctttagcgcttaaccttgccagcatgcacaactcgccggaccgttctacaaaaagtacgcggttccgcatgtaaagcggttccacagcttgtaaacacagggtttcaggttctctttcactcccctcccggggtccttttcacctttccttcacagtactatgctctatcggtcactaaggagtatttagccttacggggtggtccccgctctttcccacaaggtttctcgtgtctcgtggtactctggatcctgccttgtcctctttcctttcccatacggggctttcaccctctctggctggctttcccaaaaccattctggtagaatcaaggaatcaattttgcagtccgaaccccagcatgcacgcacactggtttgggctctttcccgttcgctcgccgctacttaggaaatcgagttttctttcttctcctcggggtacttagatgtttcagttcccccggttcccctccatacgttatggattggcgtatggatacatgaggtcttctcatgtgggtttccccattcagatatctccggctcattggatatttgctcctccccgaagcttttcgcagcttatcacgtctttcatcggctcttagtgccaaggcatccaccctgcgctcttttttgcttggccattcagatcttatagcgttaacatctgacggctggtgttgcttggtttgtttctatttcttcgctgtatttctacagcgcctcgtttcgtctctatcttacgttttacgtattttagatgtttcgtatatgcagttttcaaggtacataaagatgcgagcacatttgaaaattttaaatcttctttctcacatctggctgttttatcagccattcaaacacaaaaactttttatgcttgaatcactggtaaaaccagtttatcctcatcagcacttccctgctgttttaggttgacactttcgtgtccgttctattttctaggctttttctttccccagcctttttttaagggattccggcagccacctgctttcccatgccgtctccagcatagtatcatcggccgcttaagtcttaaccatcgtgttcgggatgggaacgggtgtttcccctaagcgcatcgccaccggaaatatgttgttatctgttttttattgataactcaacagtgaaacacttacgactacttcttcttccttagaaaggaggtgatccagccgcaccttccgatacggctaccttgttacgacttcaccccagttatcaatcccgccttcggcagctccctccctaaggttgggtcactgacttcgggcgttactgactcccatggtgtgacgggcggtgtgtacaagacccgggaacgtattcaccgcgacattctgattcgcgattactagcgattccagcttcgtgcagtcgagttgcagactgcagtccgaactgggacgttatttttgggatttgctccccctcgcgggctcgcttccctttgtttacgccattgtagcacgtgtgtagcccaaatcataaggggcatgatgatttgacgtcgtccccgccttcctccaggttatccctggcagtctccacagagtgcccagcttcacctgctggctactgaggataggggttgcgctcgttgcgggacttaacccaacatctcacgacacgagctgacgacaaccatgcaccacctgtcttctctgtcccgaaggaaaggtcccattacgaaccggtcagatcgatgtcaagacttggtaaggttcttcgcgttgcttcgaattaaaccacatgctccaccgcttgtgcgggtccccgtcaattcctttgagtttcattcttgcgaacgtactccccaggtggaatacttattgcgtttgctgcggcaccgaagagctttgctccccaacacctagtattcatcgtttacggcgtggactaccagggtatctaatcctgtttgctccccacgctttcgagcctcaacgtcagttaccgtccagtaagccgccttcgccactggtgttcctcctaatatctacgcatttcaccgctacactaggaattccgcttacctctccggcactcaagaaaaacagtttccaatgcagtcctggggttaagccccagcctttcacatcagacttgctcttccgtctacgctccctttacacccagtaaatccggataacgcttgccccctacgtattaccgcggctgctggcacgtagttagccggggcttcttagtcaggtaccgtcattttcttccctgctgatagaagtttacataccgaaatacttcttccttcacgcggcgtcgctgcatcagggtttcccccattgtgcaatattccccactgctgcctcccgtaggagtctgggccgtgtctcagtcccaatgtggccgttcaccctctcaggccggctactgatcgtcgccttggtgggccgttacccctccaactagctaatcagacgcgggtccatctcataccaccggagtttttcacactgtatcatgcgataccgtgcgcttatgcggtattagcagccgtttccaactgttatccccctgtatgaggcaggttacccacgcgttactcacccgtccgccgctcagtcccttacatcttcccccgaaggttctgtcgtaagcgcttcgctcgacttgcatgtgttaagcacgccgccagcgttcatcctgagccaggatcaaactctctgatatagtgtttgtccaagttcaagataactgcttggctatctatcccttttactgttttggtttattgaaccgttctttttttaataaatgaatgtaaaagaattttcgttttcatgtgtttcactgttcagttatcaaggttcctgtcgttctttttatcagcgacagctcttatattatatcaaagctgtttttgtttgtcaagaacttttttaacttttttcaaagttttttattttgacttgttgtcgttttctgcgacagctataatagaatatcacatctttatcagcttgtcaacagtttttttacttatttttttatttctaaagagaaacaaaaaataagaacggagaaagagggatttgaaccctcgcacggcgcaaaccgtctatacccttagcaggggcacctcttcagccacttgagtatttctccattgcctgaataacaaatcattattcaattttgctcaactacgtgagcaatgactattatatctaataaactattaaatgtcaatcactttttttcatttttttcaattattttttcaatccgtatttttacttcttttgcaatctctacagacttcatatccttgtattcttcataacggattggttcaagaaaatgcacttgtactttaatcttttcaattgagtttacatcaaacggtttataggaatcaattaacgcaaccggaacaataggacactgtgctttcattgcacacttaaagcttccacctttaaattcatttacatgattcggattctttgtacgagttccctctgcaaagatcagataattccttccggattttacttcttttgttacctgtaccataacccgcattgcctgttttacatcttctctgtccagtgcataagctttcatacatgcaaaaacctgttttaaaaatgggatattctgaatttcttttttcatgactacagaaaacggtgtcgggcatgcatgtataattgcaagtacatcaaataagccctggtgatttggaaagaacataaatccgttttcttttggaatattttcctgaccatgaatttctatctcaactcttccacctttaattgcccgctcatcgatatagcgaagcagttcgtatctttcttcttcggtatacttatccgtatgatttgcataataacaaagtttataccacatatacggcactcgtaaaatattatacagtaccattaaaataattctcttcataatatctttcactttctttaactacaccaaactactgtaaaacaaactccccagcaaattgatttcactgaggagcacctgtttttaagtttctgtctgttctaataagtttgtaagttcttcttcataagacggattttttctcgtaaactgcttataatccttttcataagttttatattcatctgtcttcatgaatttctgaaattcttttttggaattttcactcatttcctctgttacatctttcgcctgcacaatcgaatactttttattgttattttgaacatagtaaacagacaggcatggaatctccaaagtagttttactttctgaatcctcttttttcagtgtataaatcgcatacatcaactcatatccattaaaagaacctaatgattcacattttgtaaactttacgctctttgcatcataagcttcaaacaatgtcatataatgtttgatttctgttttcagttcacttgaaactttgtcctttttatccataccaaaacatttctttactgcattttcatctgttttggtataagcctctattaatgactttgttattttttcaggggattttgtatttactttcgttccacatccgcctaatgacaacagtacaatgactgctgtcatagacagaagaatccctcttaattttttcatcataactctcctcgtacttatcgtacttatgcactctattcttttgctgtctcagtttcttcttccgtttcttctgattcctcttctttttctcttacttttgcaatacttgcaactgtaatatcatttttcagattcatcagctttacacctgaagtaattcttccaagaatggagatatctttacattccaaacgaataataatgccttctgttgtaatcagcataatttcgttttcttcattgaccgcttttacaccaactacatttccggttttttctgtaatcttataacattttacacctttaccgccacggttttggcaggtaaattctccaaccgaagtcctcttgcccattcctttttcagagacaatcaacagataatctccctgacagcttaactgcatgccaatcacttcatcttcatcctgaagattaatgcctcgcacacccatagaaactcttccggtctgtcttacatctgactcatggaaacggatgcactgtccgaattttgttacaagaatcacatcttttttgccgtctgtaaatttaacttcaatcagttcgtcatcatctcgaagagaaattgccgcaagtcccgtttttctcacattgctgtaatcctcaatcggtgtctttttgacaacaccttttctggttgccataaacagaaattctccggctttgaattcattaaccggaatcaccgctgtaatcttctcttctgcctgaagggataacagatttacaatcgctgttcctctggctgtacggcttgcttccggaatctcataagctttcagacgatacacacgtcccatattcgtaaagaacatcagataatggtgagtcgttgtcatcaacagttcttccatatagtcgttatgaatggttgccatgcctttgattcccttaccgcctctgttctgactgcggaagttatctacggtcatacgtttgatataacctaatttggtcatggcaatcaccgtattttcttttggaattaaatcttccatggataaatcatattcatcaaaaccgatggatgttcttctgtcatctccgtatttttcagcaattaataaaatttcctgtctgataacacgaagcagaagacttctgtcacctaagattgctttgagttcacggattttattcaccagctcatcgtactcaccctgcaggcgggcacgttccagtccggttaatgcacgcagacgcatgtctacaatcgcctgagcctgaacttctgtcagtccaaatgcagtaatcaatccttctttggcttcctgtgtatttttacttgcacggataatacgaatcacttcatcgatattttccagtgctttcaaaagtccttctaagatgtgggctctttcctgcgctttatttaaatcatatttggttcttcttgtaactacatcttcctgatgctgtaaataatatttcagcatatccagaagattcatcactttcggctcattatttacaagcgcaagcatgtttaccccaaaggtatcctgaagctgggtatgtttgtataactgatttaaaataacattcgcatttgcatctcttctcaactcgatacaaatacgcatcccctctcggtttgagtggtcgttgatagaagtgattccatcaatctttttatctcttaccagttctgccatcttttcaatcagacgcgctttatttaccatgtatggcagttctgtgacaataatctggctcttgccgtttggaagtgtctcaatatctgtgactgcgcgtactctgatttttccacgtccggtacggtaagcttcttcaattcctcttgttccaagaatcatagctcctgttgggaaatccggaccttttacgatggataaaatttcatccatcccggtatctcgatcctcttccacatagttgtcaataattttaacaaccgcagaaatggtttctcttaaattgtgcggtggaatatttgttgccataccaaccgcaataccggaagttccgtttactaaaagattcgggtaacgggacggcagtaccaccggctctttttctgtttcatcaaagttcggtgcaaaatcaactgtattcttgttgatatctgcaagcatttccatggaaattttactcagccttgcttctgtataacgcatagcagctgcgccatcaccatccacagatccaaagtttccatgaccgtctacaagcggatatcttgtagaccagtcctgagccatgtttaccaacgctccataaattgaactgtcaccgtgagggtgatatttacccatcgtatcacctacgatacgagcacattttctatgtggcttatccggtccattattcaattcaatcattgaaaacagaattcttctctgtaccggctttaagccatctcttacatcgggaagcgcacgagatgcaataacactcattgcatactcaatgtacgactcttccatttttttctgcaggtccacctcgtgaactttatcaaaaatattatcttccattcgtctctccttaactctgtttaagtcaatttaacatcatatgctgaccagaatcacgcaccaagtctcacagacgttcgacttgaacaatctattcacgcatcaaacttaaatatcaaggttcttgacatatcttgcattttcctcgataaactcacgtctaggctctactttatcacccataagtgtcttaaatgttaaatccacttctgaagaagtttcttcatccataacaacttttaacaaaatacggcgttctgggtccattgttgtctcccataactgctctgcatccatctctccaagacctttataacgctgtatacgattattgccgtcacgtccgatttcgttaagaatctcatcctgttctttttctgaataagcataatacacttttttattccgttcaatcttaaacaaaggtggctttgcaagatatacatgtccctgtttaatcagctccggcatgaaacgatataaaaatgtcagaagcagggttgcaatatgtgcaccatcgacatcggcatccgtcatgataatgattttattatatctgagcttgctgatatcaaaatcttcgtgaattcctgttccgaaagccgtaatcatcgctttgatttccgcatttgcataaattctgtccagacgcgctttctctacattcagaattttacctcgaagtggaagaatcgcctgagtcgcacggcttcttgcagtctttgcagaaccaccggcagaatcaccctctacgatgtaaatttcgcacttagacgggtctttatccatacagtctgccagctttccaggaagagacattccctcaagtgcagtttttcttctggttaaatctctggcttttcttgctgcatctctggctctctgtgaaagcacagatttttctataatgatttttgcaactgcaggattctgctctaaatagatctcaagctgattggctacgatattatccaccgcacctcttgcttcgctgtttccaagtttctgttttgtctgtccttcaaactgagggtcttcaatcttgacactgatgattgcagttaatccctcacgaatatcttcaccggaaagattcgcatcgctgtcttttaataatttattctttcttgcatactcattaaaggtttttgtcagtgcatttctaaaaccaactacatgcgttccgccttccggagttgtaatattatttacaaatccataagtgttttctgtgtaggaatcattatgctgcattgcaacttctaccataactccgtcttttgttccctcaaaatataaaatctcttcgtaaagagctgtagtacttttatttaaatactgcacaaattcccggattccgccttcatagtgaaaaactgtttcttttggttcttccccacgattatcttttgcaataattttaagaccttttgtcaaaaatgcaatttcacggaatctgtgtttcaatgtatgaaaatcaaatacggtctcctcaaaaatttcaggatccggatggaacgtaaccattgttccggtcttttccgagtcacaatccccaatgacttttagtttataaatagtttttccacgttcataacgctgacggtaaattttaccctcatgataaatcgtaacctcaagccaggtcgacagtgcatttacaacagatgcacctacaccatgcagaccgccggatactttatatccgccaccgccgaattttcctccggcatgaagaattgtaaatacaacctctaccgcagggattcccgctttatgattaattcctaccggaatacctcgtccattatcaataaccgtaatcgaattatctttgttaattgtaacttctactgtatcacaataaccggccagcgcctcgtctaccgcattatccacaatctcatacacaaggtgatgcagacctctggatgaagtactgccaatatacatacccggtctctttcttactgcttccagaccctccagtatctgaatctggtcggctccatactctgttttaatttctgtgttcatccaattcctcctgtttccctgatatcagttaacgatggttccgtctactactttgaaaagtttatttatctcaaacctgctgttcacaaattcatccagacccgtacaggtaatcatggtctgaatatttttgatgctctccagaagataattctgcctgttcacatcaagttctgataatacatcatccagcagcaaaatgggaacatctttaatttttctttctaccagatgaatttctgataatttcaatgacaaggctgctgtacgctgttgtccctgagaaccgtattttctaatgtcgatatgatttattttaacacacatatcgtctctgtggggacccgatgatgtgtttttaaatttaaaatctttttctctgtttttaagcagtatttccagaaactgttcttcttccacattgggctcataaatcagctcaatctgttctttttctcctgtaatactgctatgtatccgctgtatcacttcattcatctcacgaacaaattcacgtctgcttcgaattaccgaggctccatagcgaacaagctgttcgtcccagatatccagcgtactcttaagactttctttttgtgcaatatcttttaacaatttattgcgctgatttaaaatgtgattgtactgaaacaaatccgacaaatagattttattaagctgacataattctgaatcaagaaatctccggcgctcacctggaccattttttataatatttaaatcttccggtgagaaaaatacaatattcacaatccccagaagttcttttgctttacggattggaatcccgtcaattgcaattcctttcgctttattttttttcaaatgcatatctattctgtgggaaatgccccctttgtttattctgagcttgatatgcgattcattttcatgaaaccgaatcatctcacggtctttacttcctctatgtgactttgttgttccacaaagatacacagcttcaaggatatttgtttttccctgtgcattgtcgccgtaaaaaatattggttcccttgtcaaaccgcaaagataaaaactcataatttctaaaatcctttaattccattgattcaatatacatctgtacacctgtcgctatttcacaattttaatttcctgtccatcataagctacaacatcaccgtcatacagtttcctgcctcttcttgtatctacttctccatttacggttacaagaccatcctgaataacgtattttgcctccactccgtcttctactagattagctgcttttagtgcctgacctaattttataaattcatctcttaattttataatttccatgttttgtcctttctgcgttaatacacttccggagtctttctgtgcttccgattatcttccgacagaattaaagtttaccggaagaatgagatatacatattgtcctgcatcatcacgaataaagcaaggtgcttttggattcatgagataaatatggatttcttcatcatcaatgacctttagtgcatcaattaaaaattttggattaaaaccaatcataatatcttttcccattttgttaatgtcgatgtcttctttcatcgaaccaatctgagagtcgatctggagttccataccctcatcgttaattgtaataataattggttttttatctccttcttttacaagaagagttgcacggtcaatactatctaaaaattcttttttgttcagtgttacctttgtttcgtaatcactggacaacatctggtcaatcttgaaatattctccctcaattaatctcgaaacaacttttgtattgtcaaattcaaacagaatatgattttcagcaaaatagatatccaccatgtcttctgtctcaccggataaaatcttactgatttcatttaaagtttttcccggaacaaccactttcttgtcagaacattcattctttaacggaatctttcggattgaaatacgatgtccatcaagggatacgactctcaatgtgttgttggcaatctgaaataattcacctgtcatcagtttattgttttcatttactgcgatagaaaagatggtttgacgaattaattcttttaatgtgaactgtgaaatctgaacaccttcatttttttcgataaatggcagataagagaaatcttcacctgactgtcccggaatattaaatttcgctttttcacaagtaatggttgtgttttgtttttcgtctgtcacaattgtaacatcattatcaggtaattttctaacaatttctgaaaagattttcgcatcaagagcaacgattcctttttcttcgatagaaccctctacaattgtctcaattccaagttccatatcatttgatgtaaatttgataatattggcagatgcatcaatcaggatacactgtaagattggcattgtcgtttttgaaggaactgccttcatgacaatgtttacactttttagtaactcagactttgaacagattaatttcataatgtggataacttcctttctgtgaaaatggttttgctataaacatatatatatataatatattaatagtagtagtagtaggggatgtggataatgtggataactcttgaaacccttgtaaataaagggcttaatgggtgttgacaatgtggataactatgtggataacttgtggataactcaaaatcaatgtggataacttttctgcttaaacaacttaaaaagtacttaaaaaaaagttatccacatttttcaccgagttatccacatagttatccacaaaaaaatggcagttatccacattttttttcgagttatccacatttttgacacccaaaatgtggataactatgtcaattttcaagagaagtgtggatgaagattaattttttaattttatttaagcgaatttttagctggattaatcttctttttaagtatattaatcacttctctggtttcttcagaatactgaacttctttttcgattcgtttgattccgttcataatggtactatggtcacgtcccccaagcttgtcaccgatgattttcaaggtgatatcagtcatttgacggcagaggtacatggcaatttggcgcggataagtgatttgagagcttctcttgtttcctattaaatcactggcggataaatcaaagtgttcagcaaccgtacggataatgatttcaggggttacgaccctcatctcttcatccggagaaatgatgtcttttaagactttttcagccagagcgaggttaatttcacagttttccagattggcaaatgccatgatcttattgagagatccctctaattcacggatgtttgaggtaacgttctttgcgatgtactcaatgacatcatcatcaatataatagccgtcaagttcttcttttttcttaagaatcgccattcttgtctcgtagtcaggagctgaaatatcaacgattaagccccattcaaagcgggaacgaaggcggtcttctaagatttccatatctttcggaggtttatcagaagatatgataatctgtttttttgcaccgtgaagtgcattaaaggtgtggaaaaactcttcctgtgtagattcttttcctacaataaattgaatatcgtcaatcatcagaacatcgatgttgcgatatttctcccgaaacttagtcatggtcatatctgcattattaccactgcggatagattcaatcaattcatttgtaaaaatttcacttgtaacgtacaatacccgcgtttctgggtttttctgcagaataaaatgtgcaattgaatgcattagatgtgtttttccaagaccaacgccaccgtagataaacagtggattataagcttctcctggggattcagcaaccgcaacggacgctgcatgtgccattttattgttgcttccgactacgaaagtatcaaatgtatagcggggatttaagtttgcacgctcaacattttcattaataatagttgagggagcttgtactgtttcagatggaatatcttttggctcgattagggcaatttcatattcttctccggttgcctcagaaatggctacttttaagggaagaagataacggttagtaatatagttgataccaatcagcccggtagggactacaattgtcacttcattgtcctcaacactgtggacagtaagcgtttcaagccatgttttgaaagaaatatcagagagctgatgttcctctctgatggtattaagaatatccgtccatttttcttgtattggatgcatggtgtatctcctgtgtttaagtaaatataaaacaacgtaacaatagaaagtgcgaaaaatacactttctatcaaaatactacaagttttgtatttatctattctataataaattgggacttttatcaaccgtttaatcacaaaaatgtggaaaactatgcgaaaaatgtggaaaacttttcccaatgtggataatgtggataacttgcaaaaaagcaatgtggataatgtggataactcgaaaaaaggcattatttgcaaccagtaaatgtggataatgtggataacttctttccacattatccacacgctaaaacccttgattttaaaggattttttaaaaaccaaaaaaagttatccacattttttttgaagttatccacaaaaaaaggtcgagttatccacattttttttgaaatattatgtaaaccaaaaaatgtggataactttgtggataacttttttaaagagtggaaaaattgaaaagttatccacaaaatgtggataacttgcaaaagtgaaaatgtggataactttttcgcaatgcggataaatgtggaaaacttaaaaagcgcaaaataatccataaatgacaaattttaaaagcttcagtcaggcataaattggtataaaaaaatcgaaaaaatgcttgacggagagggggtttatgaatataattgaaatgatgtttactaaataatgcataaccataggaatactatctcaagatagatagatatttatttaaaggaggtgcctggaattatgaaaatgacatttcagccaaaaaagagacagagatctaaagttcacggattcagagctagaatgagcacaaaaggtggaagaaaagttttagctgcaagaagattaaaaggaagaaaaaaattatcagcttaagaccgcagacatgtggtcttttcttctcttttcattaaaaggatggtttatgaaatattcggagtcgttaaagaagaacagagattttcaactggtttataaaagtggaacatcaaaagcaaatcgatatctggttatgtatgtaagagaaaatcagttagaaaaaaacagagttggcatatccgtaagcaaaaaggtgggaaacagtgttgtgagacaccatcttgcgcgccttataagagaaagttaccggttaaatgaggaaaagtttaaatgcggatatgatattgtaattgtagtcagggtaaatggaaagaaccaggggttccattccatagaaagtgcattaatgcatttaggaaaactcacaaaaaccataaaaagcgaagagaatgaaaacgatactaattaaattgattcggttttatcaaaagtatatatccccattaaagagtacacgttgtccctatattcctacgtgttctcaatatggactggaagcaattgaaaaatatggagcagtaaaaggctgcttactggccggttggcgaattttaagatgtaatccattttccaaaggcggatatgacccggtgccctgatgaaccgaaaaatgatgtggataagaacacacactaattagagaaatattggggtcaccggttatataaggaggacgaattttgggtgcattgttaagtaagagttcaatgccgattgtaaaatgggtagccgaggtaatgggctggctgatgaacggcatttacaagattgggattcataatctcggtctttgtattatattatttacaattatcatttatgcattcatgatacctctgcagattaaacagcagaagttttcaaaaatgaatgcagttatgtcaccagaattgcagaaaatcagtaaaaaatacagaggaaaaaaagaccaggcttctcagatgaagatgcaggaagagacaatggcagtttatgaaaaatatggtgtgtctccaacaggaagttgtctgcagttattcattcagatgccgattttctttgctttataccaggttattattaatattcctggatatattggcgagattaaagcaatttttgacaaagccgttgtaagtatcacaagtgtagacggatacgcagatgtcctgacacagtttatcaaggatgagggattaagaacttatacttggagagcagatgatgtaacaacaaaccgtattattgatgtattatataacttatcaccaacacagtggaaacacttaggtgaaatcagtgattttagtggattctcagatgtattaagcaatacagcaaatacaattcgtccgatgcagaatttccttggactgaatatcgcagataccccgcttgcactgattaagtcaggatggagttcacactcttatctgttgattcttgcagcagttttaattccggtattatcctggctgacacagatgttaaacattaaattaatgccaacggcggcaaccactcaggacggtggagcaaatgaccagatgaacgcaacaatgaagagtatgaacacatttatgcctctgttttctgcatttatctgtttctcattcccggttggtattggtatttactggattgccggttctgtgattcgttgtatccagcagcttattattaataaacacctggacaacatggatttagaagactatatccgtaaaaatcaggcaaaagctgctaaaaaacgtgaaaaatcaggacttccgccacagaaaatcacacagcaggcaaaacagaatgtcagaaatattgaagaaccaaaatgtaccacaaatttaaagaaatacaataataacagtggttcaaaagctgtagatacttacagagaagtaccggaaacaaaaccgggaagccttgcatcaaaggctaacatggttgcagaatttgataaaaagaataagacaaagaaaaaataacggtaagggggaagcgttatggaattcaaagagttttctgctaaaacagcagatgaggcaattatcaaagccagcattgaacttggcgtttccagtgaaaatctggagattcaggttgtgactgaaggcagttcaggattttttggaatcggtaaaaaaccggcaatcataaaagctcgcagaaaagaagaaaccttaccggaagaacctgtagcagaagaaataaaagagtctgttccggtaaaaaaagaagtgaaaaaaactgataaggcagcagaaaaacctgtagaagaaaccgtaaaaccggtgagacatcaggaaacaaaaaaagagcagccaaagcctcgtgaagagaagaaaatcatcaaacgaagcgaggaagagattgcagaaatcaaagcggaagctgagatgttcttaagtggtgtatttaaagcaatggagcttgaagttgagcttaaaatagaatacacagcagaagacggcagccttgaagttgaatttatcggacaggatatgggtattctgattggaaaaagaggacagacactggattctcttcagtaccttacaagccttgttgtaaacaaaggcagacagggttatgtccgtgtaaaacttgatacagaagactatagaaacagaagaaaagaaacacttgaaaatcttgcaaagagcattgcttacaaagtaagaaagacgagaaaacctgtttctttagagccgatgaatccttatgaaagaagaattattcattctgcacttcaggggaaccgttatgttgaaacatatagcgagggcagtgaaccatatcgccatgtggttgtaaaattaaagaaataatgtaataaaaaataaagacgttctaggtgaaagcgtgaatgttggagatggattctctgtgcttttatctggagcgttttttgtttcttaagagtaaattaaaaagtatattaaattgggttaggaggctggattatgccgatactggcatcagaaacgatagcagcagttgcaacagctatgaccgcttcaggaattggaattatacgaatgagtggtccaaaaagccgtgaaattgcaggaaaaatctaccgttccaaaaatggaaaaaataagatagaagaagtaaaatctcacacgataaattatggttttatttatgatggagacgaagaaattgacgaagttttagtcatggtaatggacggtccgagaagttatacaggggaagataccattgaaattgactgtcatggcggtgtgcttgcaatgaaaaaagtgctggaaacagtcattaagtatggtgcaagaccggcagagccaggcgaatttaccaagcgtgctttcttaaacggaagaattgatttatcacaggcagaggcagtcattgatataattaatgcaaagaatgagtatgcattaaagagttctcttcatcagttaaaaggctctgtgcagaaagtaatctgtgaaatcagagagaatattatctatcatattgcatatatcgaatctgctttagatgacccggaacatatcagtgtggatggttatggggaaactttggggaaagatatcaaaattcagaaagagaaagtggaaaaccttctttctacagtaaaagaaggaaagatgatgaaagagggcattaaaacagttatcgtagggaaaccaaatgccggaaaatcgtctcttatgaatgtacttgtaggagaagaacgtgcgattgtaacggatattgcaggtacgacaagagatattttagaagaaacgattgtgcttcatggaatttctcttcgtatgattgatactgccggaatccgtgatacagaagataaagtagaacaaatcggtgtaggacgggcaaaagagtatgcaaaagatgcggatttgattctttatgtggtggattcttcacgtcctcttgatgaaaatgatgaagaaatcatggagattctcgaagataaaaaggcaattgtgctgttgaataagaccgatttggaacagaaagtaaccgaagaaatgttaaaagaaaagctttctcatccagttgtgtcgatttcagcaaaggaagaacagggaattgatgtgctggaacaggagattaaaaacatgttttttgaaggtgaattaagctttaatgatgaagtttatatcacaaatatgagacataaaacggctcttgaagaagcacttgacagtttaaaaatggttgaaaacagcattgaaatgcagatgccggaagacttcttttcgattgatttaatgaacgcttatgagtctttaggaagtattatcggagaggctgtaggggaagatttggtcaatgaaatcttctcaaaattctgtaccggaaagtaaaaaatcaggataaatatagaagcgaaaaaggagaaaaacagatgaatcatttgacagaaaattatgatattgctgttgttggtgcaggtcatgccggatgtgaagcagcacttgcgtgtgcacgtctggggttggaaacgattatgtttacggtaagtgtggacagtattgcactcatgccctgtaacccaaatgtcggtggtagttccaagggacatctggtacgtgaattggatgctctgggtggagaaatgggaaaaaatattgataaaacattcatccagtctaagatgttaaatgtatcaaaaggtcctgctgttcattctttgcgtgcgcaggcagataaacaggaatacagcagaagtatgcgccatacactggaaaatacagaacatctgactattcgtcaggcagaggtaacagagattcttgctgaggacaaacagattaaaggagtaagaacctattctggtgcagagtatgcagtaaaagcggttgtgctttgtacaggaacttacttaaaggcaagatgtatttacggtgatgtaagcaatcataccggtccaaacggacttcaggcagcgaatcatctgaccgattccctgaaaaaacttggcatcgagatgtatcgttttaagacaggaacacctgccagaattgacaaaagaagtattgacttttcaaagatggaagaacagtttggagatgaaagagttgtaccgttttctttctctaccaatcctgaagatgttcagattgaccaggcatcctgctggctgacttataccaatgaaaccacacatgagattatcagaaataatttggaccgctctccattatattccggtatgatagaaggaacaggtcccagatactgtccatccattgaggataaagttgtacgttttgcggacaaaaaacgccatcaggtttttattgagccggaaggattatatacaaatgagatgtatgtaggcggaatgtcaagctctcttccggaggatgtacagtacgaaatgtaccattctgttgcaggattagagcacgcaaaaattgtaagaaatgcctatgcgattgagtatgactgtattaatgcaagacagttatatccgacacttgaatttaaagaaatcaaaggtttgttctcaggcggacagtttaacggaagttcaggatatgaagaagcagctgctcagggattgattgcaggtatcaatgcagcaatgaaagtgcttggaaaagagatgctgattttagatcgttccgagtcttatattggtgtattaatcgacgatttggttacaaaagagaatcatgaaccataccgaatgatgacaagccgtgcggaatacagactgcttttaagacaggataatgcagacttaagattaagaaaaaaaggttatcaggtgggtcttgtaagcaaagaacagtatgattatgttttgtggaaagaagcaaaaatcgaggaagaaaaagagcgtgtggaacatacttatgtaggagcaacgaaagaggtacaggaactgcttgaacagtacgaaagcacacctcttaaaaatggatgttcccttgcagaattaatccgccgtccggaattaaactatgaattattagctcctttagataagaaaagaccggaacttccggaagatgtaagagaacaggttaacattaatatcaaatacgatggatacattaagcgccagatgaaacaggtggaacagtttaagaagctggaaacaaagaaacttccggaggaactggactatgaagcaatcagcggacttagaattgaagcaagacagaaattagaagaataccgtccggtttctgtaggtcaggcttccagaattgcaggggtttctccggcagatatttctgtccttcttgtgtacctggaatcttatcgaagagggggaaatgggaatacatgaattatgatttaacgctgttagaaaacgctgtaaaagagtttaaaattacactttcagaagaacaaaaagcgcagtttattcagtattatgagctgttaattgagtggaataaggtgatgaatctgaccggaattacagagtttgatgaggtacttcagaagcattttgcagacagtctttcggttgtaagagcactggatatgagcaaaattgagagctgtattgatgtcggaacaggggcaggatttcctggaattccattaaaaattgcgtttcctcatctgaaagtaactctgctggattccttaaataaacgtttgaaattcttaaatgaagtcatcgaaaaattaggtttagaaggcattgaaacagtacatggacgtgcggaagatggtgcaaaaaaaccagagcttcgagaggcttttgatttaagtgtgacacgtgcagttgcaagggtaagtgtaatcagcgagtattgtctgccttatgtaaagacaggtggatactttgctgcatataagtcgggaaaagcggcagaagaactggaagaaggcaaaaaagcgattgcagttttaggcggaaaagtcgaaaaaacagaagaatttttgttgccggactcagatatggaacgtacgattttgctgataaaaaaagtaaaaaatacaccgaaaaagtatccgagaaaagcaggaactcctgcaaaagaaccgattgtataagtggaaaattggataaaaaattgtatgaaaataaagaacgaaagagagctgaaaaaggctctcttttttttattagggatatttgcaaggattcacagaaaaaacacattctcatctaatttttatcacaaatagtaaatagaatagaacggtgagaaaaatataaaaaagcaagtacaatattaaaggagggaataccttgattgaagtaaaggatctggtcaaaaaatatggtgaccatgtggccgtagaccatttgagttttaccatagaaaaaggaaaaatttatggatttttaggaccaaatggagcaggtaaatcgactacaatgaatatgattaccggctacattgcctcgacacagggagaaattctgattgatggacacaacattttagaagagccggaagccgcaaaaaaatgtatcggttatttgccggagctacctccggtttatcaggacatgacagtcagagagtatttaaaatttgtagctgagttaaaatccattccaaaagcagagcgggaaaagaatataaaagaagttatgtcaactacaaagcttgaggaagtacaggaacgtctgattaagaacctttcaaaaggttttaaacagagggttggaattgcacaggctctgcttggatatccggaaattattattttagatgagccgaccgttggtcttgacccgaaacagattattgaaatcagggatttaattaagagccttggagaaaaacataccgttattttaagttcacacatcctttcggaggtaagtgcggtctgtgaccatgtattgattattgaccgtggaaaactggtggcaagcgacacaccggagaatttaagtaaagtaatggaaggcgcaaattctcttgaacttacagtaaaagggaaagaagaagaaatcagagaggcaatgaacctcgtagaaaatattcaggaaatgatttaccatgaatcttttgtgccggatgcctgtgattttaccgttaaaatatcaggggaacaggatatgagagaaaacattttctttgctctggcagatgcaaaatgtccgattttaaaaatgcagccgacaaatatgacgctggaagaagtattcttgaaattgaccgaagacgacaatgaggaggagaaagaaaatgctggcgatttataaaaaagaattaaaaagttatcttacatccatgcaaggatatgtgtttatggcatttatcatgctggttctggggatttattttacggcatataacttaaattatgcaagtccggactttggaacaaccttaaattccgtgacgtttgtatttttgattatcactccgattttaacaatgagaattttagcggaagaaaaaagaaataaaacagaccagttattattcacttcaccggtgccaatctggaagatagtatttggaaaatatcttggaatggtgacaatttatctgattccagttgtgattacgttgttttatccgcttattttggcaaaatacggaacagtttcttatcctatgaccttaactgcaattgttggatttttctttttgggatgtgccaatattgcagttggactttttttatcttcgattacggaaagtcaggttatcgcagcggttcttacctttgtggtattattctgcagttttgtcatgaatggaattgaatctttcttttcacagacggcgatggcttccatgcttgcatttgcggtacttgcagtcttaattgcaatggtcgtctatcagatgacaaaagataatattttgaccggaattacaggagtggtactgcttggagcagttgtaattatatatattgtaaaatcctctttgtacgagggagcaattcaaaaattgttagatttgctcgcaatcgcaaatcattttgataattttgtaggaggaattttggatttctccggaattgtatatatgttatccgtaatctgcattttcatatttttaaccgttcagtcaatacagaaacggcgttggagctgatgatttgaggtgaatagagaggagaaaatgcaaatatgaagacaaacaatgaaaataaagagttaaacaaagactcaaataaagatttaaataaagacttaaataaagggtcaaatgaagatttaaataaagagtcaaataaagacgtaactaaaaaaacgaataaagagtcaaacggcaaaaaattcaaaaaaatagatttcaaagaattacgaaagaaaagcaaggaaaaacgaatccaaaataaaaagaacttaaagcatggttcctacagcatgggtgcaattacaatttttattgcgattatcgtagtattaaatctggtattgcaggaagtgccgtcaaaatacagagaaatcgatttaagtacgcagaaactttacagcattggtgaccagacaaagaaagtacttaaaaagctcgataaagacgtagagatttattatattgcgcagagtggttcagaaagcagtgatatccagaaacttctggaaaaatacgaagagggcagtgaccacatcaaagtggaacagaaagaccctgcagtaaatccgaaatttgtttcacagtatacatcggatggcgtgagcaataacagcgtaattgttgtgtgcggagataaaaataaagtcattgataacaactcattatatgaaacgactgttaattatcagacttacagtaacgaggtaaccggatttgatggagaaggccagattacaagtgcaattaattatgtaacatccgatagtatgccggtgatgtatacgttagagggacacgatgaagcaaccatgagtgataccttaaaagataccattcagaaagcaaatatcgatattcagtctttaaatctgctgacaatggacagtgttccggacgatgcagacatcttgtttatctttgcaccggcaaaagatatttcagaagatgaggcgtctaagattatttcttatctggaaaatggcggaaaagcgttgatagtttctaattattcttctgaagaaatgccaaattttgcttctgtattagagaattatggtgtgaagacggcaggtggaattgtacttgagggagataccaatcattatatttctcagaatccatcctatctgcttccaaatatcgaaagtaatgacattacttcaagcctgtcatctggcagtcgatatattttaatgcctctggcacagggaattgtaaagagtgataactacagagattctcttgaaatcactgatattctgacgacttcagacggttcttactcaaaagtaaatgtagaagatatgcagacaatggaaaaagaaagcgatgacattgacggaccatttgcagttggtgtttccatcacagagaatttagatgatgagaaagaaacacagattgtttattattcatccgaagcgctgtttaatgaccagatgaacacaatggtatccggagcaaactatgaattgatttctgcttctgtaaactggatgtgtgagagcgaagaggatagtaatacaatttctattgcaagtaagagctatgatacttcaacacttacaattccggcagcagatgcaagtttctggagtatctttgtaacagcagttgtaccggtagtgattctggtaattggcggtggtatctggatgaagaggagaaaacagtaatgaagaaaaaaaatatcggattaatcgcaggaattgtactgcttgttgtgctctgcgtagtctattttgttcttcataatcataatgccagcagcagtgaagcagatagtacagatacagcagcaacagcgtttgagacagatacagacaaattgacagagctgactgtgacaacggaaggtcagtcttatacttttacaaaatcagatgataaatggagttatagtgcagatgcttcatttccactagaccagagtaattttgaagagctggcaggaaagttaaaatcaatcagttcagacagggagctcaaagatgtagaggctgtatcagagtatggacttgatgtacctgctgtacaggtttctattaaaaattcggatgatgaaacccatacattagagtttggtgcagtaaatgacatgacaagcaattgttatatgacaattgacaaggataccagtaaaatctatatggttgcttctgatcttgaaaccgcttttaattttaatttaagtgaccttgcagaaaaggaaagtttcccgtctattacagctactacagttacgaaactgactgtagaaaaacagggcgaagaagccgaagtgattgaaaagagtgattctgcttccaccggatggagttatacaaaaggaagcacacaaagagatattgacagttctaatacttccaatctcttaaatggaatttccagtctttcctggggcagttttgtaagtgcagataccagtaagcttgcagagtatggattggatgcaccgaccaagattatgattgattatcaggtgacagagacaaaagacagtgacacgagtaccagtgaagatgatacgagtgaagacagcagcagtaatgaagatgcagaaaatgactctgacagcgacagtaccacagaaactgtgacaacgaataagcaggaagttttgcttcttggaggtcaggacagcagtgggaattattatgcgaagcttgaaagccagtccaacatttataccatttcatcttcgagtgtggaaagtttcttaaatatcgacgtgaaaactctggtcagcaattatgtctctaattatatctttgcagacctcgaccgtgtaacaattcaaaaagatggagaatcttatgaatttacaaaaacaacggaagagaaagcaaaagaaaaagatgacagtgatgattcaaagtctgaagatagtgatacagaatcggatacagaaactgtgacaacctattttatgaatggaaacgaaataaaattggaagatttctcaagcttctatagtaatatcagttctctggaatgtcaggagtggcttgatgaagtaccggaaacacaggatgagccggaaatgactgtagaattttataaagaaaatggagtttacttcaaagtagaatattatccgtatgattctaacttctatcttgtaaaaaataatcagggaactgcgtgtctggtcaataaaatgaagataaaagaaattgaaagttcttttgaaaaatttttggaaaaacagaattaatgagtagaaattaaaaagcgagaggaatgtttcacgtgaaacattcctctcgctttttagtcatcaagaaaaacagacagacaatcaaataactgttctggtgattctaactgaggaagatgttttgcttcttttaaaatgtaagtctcaattgccggatttaattctacatattgagagagaacttcgcacttagtgagttcgccttccccttcgataataaagatgctgttgtttatattttttaatgcatgtacgatattgttgttagtatatcctccaagtaaactggagaataagaaacgaccgcttcccatgcctttgtgggctgcttcatagtaagtgtcgagccattccgctttgatatggaatggattgtaaagataatcttctgtaaatgcaagttgaacattactctggcagaccatcatgttataaacaagagttccgaacacaggaagctcaagaaaagatttataaagcttgctgcgtttggttggaatcttatttaactgtgaaagtgccggcggattaatcattaaaatttttctaaacagttcgttttcgttatgacaggcgaggattgtaaaagagccggaaaaaccactggtaatcacatcggttctttcgtgaattacgtttttgataaaatcagatattgcctggacatataaatagttggtgtaagtaatatgctgtttatcagaacggccgcatccaggtaagtcgatgcagtagacggtatgatttttctcaagctgttttacaagtgcttcccattcataagcggaactgtaaatggttaaatcgtgaattaataaaacgggagaacccgtaccttgttttgtgtaataaatttttccaaaacgccaattgtaataattgcttgccgttgactttaacaagtctttcattattgcggttgtagaaatcagatggttcatgaaatgaataatagcagttgcggtggtaaataatataccggttgtaataagtttgtatctatgctttttcataaaaaaacctcccaatataggattactttagttagttataattataagccattaactcttattatacaagctgaaagtagggagaagaatagtgtgataataaaaaaaatgggaaatgtttcacgtgaaacatttcccatttttttattgattgattaatgaaatttatatcgtaaaaaaatataatgtttcacgtgaaacatttgtgtagaaatacgtttaagaagatgttataataaccattgaatgaaataaatacgaagtttgatgaaaagaggaaacttaagtgggaagaataatagcaatagcaaatcagaaaggcggagtaggaaaatctacaactgcaatcaatctgtctgcatgtcttgccgagctgggacagagagtccttcttattgatattgacccacaggggaacacaacaagcggagtcggcgtagacaaagataatgttaatgcgactttgtatgaacttctggtgggagagtgcgaaatttcggactgtctgattgagaatgtattcgaaaatttatccttgattccgtcgaatgtgaatttgtctggtgcagagattgaactggtaggcgtagaggggcgtgaatttcttttgaaaaatcatattgattccattcgtgataattatgattttattattatggactgcccgccgtctttaaatgtgttgactatcaatgcaatgacaacagcagattctgtactggttccgattcagtgtgagtattatgcactcgaaggattgacacagcttattcacacgattgaactggttcagaaccgtttaaatccggatttggatattgaaggcgttgtatttacgatgtatgatgcaagaacaaatctgtcattgcaggttgttgaaaatgtaaagaacaatctggaccagtctatttacaagaccattattccgagaaatgttcgtcttgcggaagcaccgagttatgggctgccaattaccttatatgataaaagatcagtaggggcggaaagctacagactccttgcagaggaagtattacacagggaggatgaagaatggcggtaaaaagaggtggacttggcaaaggtcttgattctatgattccggttttagattctacagcgacaaaaaagaaaaccggaagaacagcaatcgataaagaagcgctgcagaatgcggcaaaagaagctcataaacatcaaaaagaaaagatggaatttgaggggaaacctggagaacaggtacagattgtgaagctgacaaaggttgagccgagcagggaacagccgagaaaacagtttgatgccgatgcacttcaggaactggcagaatctattaagcagtttggtgtacttcagccattattggtccagaagaaggaagactattatgagattattgccggggagcgcagatggagagcttctaaactggcaggactcaaggaggttcctgtaattgtaaaagaatttacagaacaggaagccgttgaaatttctctgattgaaaatattcagcgggaagatttaaatccgattgaagaagcaatggcatataaacgtttgatggaagagtttcatttaaaacaggatgcgattgcagaacgggtttcaaagagcagaactgcagttacaaactcaatgcgtcttttaaaattagatgacagagttcagcagatgctgattgatgaaatgatttcaaccggacatgcaagagctttgcttgcactggaaagtaaggatgcacaggcggaagcggcagttaaagtattcgatgaaaaattgagcgtacgagaaacagagcgtttagtgaaagaactgttaaatccagtgcagaaaaaagaagagaaacccaaaaatcaggcagaagaactggtttataagaatctggaagagaaaattaaacagattatcggttcaaaggttgcaattaaccgaaggacagataataagggaaagattgaaattgaatactattctcaagaagaattggaacgtattgttgaattattggaaacaataggataagagagaaaacgaggagttagagcagatgggtaatctaatcagcaagattcagtctatttccggtgtgctgtcaatttttttactgattgtggtaattgcacttttggtatgtgtggtcagtctttttttggaagtaaaccgactgaatcaaaaataccgcgtatttatgaaaggaagagatggacagtctcttgaaaaatcgttccgacgcaaatttgcaatgattgacaaagggctggatgcggcagcggcaaatgagcaggaaattgaaaaattaaaagaaatcatgggaaacaccttgaacaaatatgctattgtgaagtatgatgcatttgaggatatgggaggaaaactcagctttgttctggctatgttggacgataagaatacaggatttcttctgaatgcgattcacagcagagaaaactgtttcctctatattaaagagattgtaaatggggaatcctatgtaatattaagccaggaagaagtgcaggcattaaaacaggccgtaaatttcagacaaaactaaaaaaaagaagcagggagaaagattatgttagacattaaatttttaagagaaaatccagatgtagtaaaacagaatattaaaaataaatttcaggacagcaaattacctctggtagacgaagtaatcgaattggataagagaaaccgtgaaatcaaaggagaagtagaagcgttaagagcagaaaaaaataaaatctccaaaatgattggtactcttatgaaagagggcaaaagagaagaagcagaagaagtaaagaaacaggtaactgcaaatgcagagactgtagaccgtttatctgctgaagaaaaagaagtagaagaaaaaatcaaaaaaatcatgatgacaattccaaatatcattgatccatctgttccgattggaaaagatgacagcgaaaatgtggaagtacagagatatggtgaaccggttgttccggactttgaaattccatatcatgcagaaattatggaaaaattcaatggtcttgatttagacagtgcaagaaaagtagccggaaacggtttttactatctgatgggagatattgcacgtcttcattccgcagttatttcttatgcaagagatttcatgattaatagaggatttacttactgtgtaccgcctttcatgattcgaagtgacgttgttacaggtgttatgagctttgcggaaatggatgcgatgatgtacaaaatcgaaggcgaagatttatatctcatcggtacaagtgaacattccatgattggtaaatttattgacacaatcattccggaagaagagctgccaaaaacactgaccagttattctccatgtttcagaaaagaaaaaggtgcacacggacttgaagaaagaggtgtataccgtattcatcagtttgaaaagcaggaaatgattgttgtctgcaaaccggaagaaagcaaaatgtggttcgataaattatggcagaatacagttgatttattccgttctatggatattccggttcgtacactggaatgctgctctggtgatctggctgatttaaaagtaaaatctgtagacgtagaagcatggtctccaagacagaagaaatattttgaagtaggaagttgttcaaacctcggtgatgcacaggcaagaagactgaaaatccgtgtgaatggaaatgacggtaaatacctggcacatacactgaataatacagttgttgctccgcctagaatgttaattgcatttctggaaaacaatctgcaggcagatggttcagtaagaattccggaagcactgcagccatacatgggtggaatgactgagataagataaggaggcagtctttgcacagttatttaaggtccattggtttttcagaactggaaagaaaagaacttgaccagattttgaaagaggtaattacacaatacgatgaaaagacagtaatagaaaactctgagggacatctgtttgtggaagtatcaaaaatatttggatgtgacgttggaatcacagtctgcggagaatacgatgaaaataatgaatttgagatggaatattattttccgttcttccgcggaactggaattacgacacaggaaaatgtgttaattgaacgccatgtgggaaaagagtcctatgccggagcagtggatgatataagaatcggcgttacaattatcttttatctgcaaaatgcagccgaatatctgacagaacaccggcatggacattatacaaagggtgtgtatccggtgactcttgccggacttgcaagagaagccagaattcttcttcctgttaagaaagatgaaaaacagcaaagagaagaacgggagaataccgtgaatcgtaatcgaatgattgcagcagcccgtaatggtgatgaagaagcaatggaaaatctgacgatggaggatattgatacatattccatgatatctggccgtatagcaaacgaagatatttattcgatagtggatacttattttatgccttatggaatggaatgtgatttgtataatatcatgggagaaatcacagaatggtccattacaaaaaatacactgacaaatgaagaaatctatcagattcgcattttctgcaatgatatggaaatggatatctgcgttaatgcaaaagatcttttagggaagccggaagttggacgaagatttaaaggagttatatggcttcagggaaatgtggatttttagatgaaacctgagaattaaaagaaagaatcttgcttgcgagattctttcttttgtttcacgtgaaacatattatcggttgagggtagggttaaattatggtagaatgataccacatgatacaagacagtgtcataaaaactcacaaattcaccaaagataaagtgatattgtgaaataaaaaagaagggaaaaggaaaaaatggagttatttgtcaaagtgatgaatgtagtcaatgatatcgtatggcatcctgtaatgtgcgtgtttcttatgtttgcggcgttgtggttcacgtttcatttaagaggcatgcaggtacgaagatttggcgatatgcttaaatgtctgactgaaaagggcgacaataaacaagatactggtctttcttcttttcaggcatttgcaacaacagttggaggtcgtgtaggaaccggaaatattgcaggaacggcaactgcaatttttatggggggacctggtgcaattttctggatgtgggttactgcaattttaggtgcatccacaggaatggttgagtgtatcttaggtcaggcatataaaacgagaaatctgggagaattaaccggaggacctgctttctatatgtcaaacggaattaagaataaaaaattaggaaagatactggcctttttattctgtatcgcagtctttatcggacctggattcttgcttccggcaatgcagactcagacagcggcaacagcggtaaatgtagcatttggacttccatttgttgttgttggagtgattatgacagcaattgttgcatttgttattatgggaggaattaaacgtatcggacaggttgcggaatttttagcgccggttatgtgtggaatttatttcctgattacgattattattattgtacttaatattggaaaagttcctggaatgtttggttctatctttgcaagtgcatttggaaaagatgcggtctttggcggaatcgttggttcggcagtttcctggggaatcaaacgtggattcttctcaaatgatgctggtaacggaatgagccctttgatttcagcaacaactgatacttctcatccggtaaaacaaggtttggttcagggattatctgtgtatatcgatactcttttggtatgtacttgtaccggaatttctattttgcttgcgggaacttacaacgttgcagcagacggagcaggtgcttctctgttagtagagcatgttccgggaatacagtatggaattgcatttatgcaggaggcaatgtcggtatcaatcggtaaagcaggagcaatgttccttgcaattatgctgtttatctttatttttacaaccatgctgtcctattcttatcagttggaatccacatgtaaatatctgttcggcgagaataaaatggtggttacaattgtgcgtattttattcctggtattctgcatgtttggtattttgattgatggtgatactatctggccaatgggtgatattggtgttggatgtatgctttgggttaatacttttagtatcttactcttaactcccaaggttttgaaaatcgtaaaagattatgagaaacagaaaaatgttggcttgaacccattgtttgaccctgctacagtaggaattgaagataaagcgggggtatgggatacttatgtaaaacagaaaaaagagcgtggagattatgaaaatccgcagcttggatatgataaaaaataagaaacttttgtagagatatactcttgtaaggttttggctataccttcagaaaagatttcgagagtatattaagattacatggaggtgtgcagacgtggaatttgattttaaaaacgaatttgaatctatgatgaaatcgaatgaactggacacggttgttgttttgggacacatcaatccggatggagatgcagccggttctgtgatgggaatcgcacattatattggcgtgaattatccggagtatcaggtattcccttatctggcggatacgatagacaaaggaccaaaacttcaggtgcgccaggataaaaaatttgatccgtttgaaaagccggatttgcagggaaaacgtttcgcaacagtgatatgtgatactgcgacattggcacgtttaagcggaagagaattttatgaagcatctgtcgcttctattgtaatcgaccatcatgcctcaaatgagggctatggagacagaaactatacaaaggtttcggaagcctgcgcggtaaatgtattttatagtttgaatcaggatgatttaaaaaaagcggcagaggcagaagaatatccaaacgctgcagattatatctatcttggaattgtacatgatacgaatgcttttcaaagagcagatgaaagtatcatgaaggctgcgacaaagcttttagaacttggcgtagaccatagacgaattatacagactcggcagattgatacgttagaagatttggaaaaacgtgcagacattttaaaaaatgcgatacgtgtgctggatggaaaagtcgcctacgtgtgtataaacaaagaagaaaaggttaaaaagaatatcagctatgaggaaattcatccaatcagcagtattctgcgtgactgtgcagacattgaactgggatttacaatgtatgaagaagaaccggacaggtggcgttgttctttccgctccgatggaaagtggcttgatgtaaatgaattgattacaccatttggtggaggcggtcatgccggggcagcagggcttagaaaacgaaccggtgatatggaagaacttagaagtcagattcttgagagagtaaaaaaactaagagcagaaaaatgtttcacgtgaaacaaagcggttgtcagtttagttaatgacagccgctttttgttacttgtacggtgtactggtttaaatgtttttaatatagaagcaaggtttgcagaaaccagatgttgcttaatgactgcgttcatgagtaagtagcgaagcggattgcgaatgtccgctttacgagaatcaaccggtgaattataaaatgagttttcattaaatcagtggattgtgaatatttgtttgataaaaacaagatattgttaaaaaaatgtttattaaactagatatagtattttctgattttgtatgttatactgacactagattacagaaaatcagaaaaaacgtgaaaattgcccgtcacaattacgacagtaatagcatttccagatattctatgataatgagtggggatatacatctcagattttcagactcattcagtatatgaatcagattgatactggtcgataacatttaagatgtgacagggcagttaaattctgattttaacgtaacctgctttctgtaagggacatatccattcgttattacgattatgaaccgtaaatgaaaatcggaagccgggagataagtctggcttccgattttttgtatttagatgctctggtaacttagttaccgaggagtttacatagttgtttcgtatgtttgttttctggtaacccagaaaaagacgcatacaaagataattcctttgataatcgatgtggaagaaaatgcccaccagattccgtgcagtccaagggaagtattttttaagaaaatagcaagagggatccttgaacctgtaaatataatactgatgatactgcaaaggcgggtcattccaagtccggaaagagcaccgattgtggtcagttcaatacacataaagccttcactgaatccgatgataataagatatccgactgcgatggtaatcgcttttggttcatgaaagaagattgttgcaattgtatttggcgcaaagacaaatacaagagtgataatcagcccccagatgccaacggtccataaagaagcatgatatcctttgcggacacggttcatttttccggcaccatagttttgagcagtaaaggcatttaaggctgatgcaaaaccatctgcagtattccaggatacggactcaatctgacctccgactcgttgtgtggcaaccgcttctgcaccgaaagcagataccatacgggtaagcaccatcgagataatacaatatgccataccctgaatggcggtaggaattccaatccggcagataccatttaagtaaggtgccggaatttttgtaagtaaatgagttccctttaatacattttcttttttctgcttgataacgcagattatcataatgctcataacgataaactgtgcagttacggttgcaattgctgcaccggtaacgccaagctttggaaatggaccgggaccaagaattaaaacagggtctaaaatcatgtttgtcacaagtccgatgagattggcgagaaatggtgtttttgaatctccttgcgcagtataaattccggttaacgtgactgttaaaaaagaaaatacaatcagtccgcaggcaattttcgtataggacaatgcggctgagactgcttctgggtcattgagcttaaaaaatccgaccatctgccggacaaaaatgaggcataaaatagcgtaagccagtcccataaaagtagatagctgcacagcggtctgcgcaaaaccgtgtgctttttctttttctccccgtcctaaagactgtgcgacttttacctgaccacccatccttgccatggaagccagtccctgcgaaagccaggtaaacataccaccaactccgactccggcaacggcttttgaaccaagcagaccaatccatgccatatcggtgatattgtataatgtccccagaaatgaagaagccatgatggggagtgcgagtttggttaaggtctttagaataggaccttttgttaaatttccatccaacgtatttgtgtaacctccaaattattctgtatatctatgttatcttattttatgaagaaaagcaacgagaaaaaagaaagaaaatttgaaggattcattgagaaaatctggatatcatgatattctgtagtcagaaaatgtcaaaaaggagagaactatatgaagaaaaaatcgtttttgctatcatttttccttgccatgctttttgttgtattaggcagtgtgaatgtaaaagcagatgaaacattggaaggatacacttatgtcaatccaatgtatgaagaccttgaggggaattttgagtttgagtctgattttgagctgtattctgagtctgatagtgaggaatcagatgaagaggatggaattgacacttatgattcgaggagtgttcagtatacgagtgacaagcagagtctgataaagacattcagacagcagttagtcaatcgtgcagaaacaattgctttgtattatcactgtaatcagaagattacacaggatttttttgacgagttctctgctgaactgtttaatggggcagtggcacatacgggtgtaggaaaagagggagattatatcagatggcactaccagggatggcgtgtcaatgcaaattataaaacggaccgcaatggtggatacaatttgaatattacttataatatgtattatttatcagacgcatcacaggaaagtcagatggatcaggcggtttccaatgtgttgaagtctttaaatctttcaaataaaacagattatcagaaaatcaaagcgatttatgattatatatgttccaatatcacgtatgattatgtaaatttaaatgatgattcctatctcttgaagcacaccgcatatgctgcattgattaataaaacggcggtttgtcagggatatgcaacattattttatcgtctgtctttggagtcgggggtagatacgagagtcattaccggagattccggaggtccacatgcatggaacattgtgaagctgaatggaaaatattataatcttgacagtacatgggatgctggttcatcaagctactattatttcttaaagagcatgaatgatttttctaaccatacgagatatgaagaatatcagacatccgattttacgtccgcttatccgatggcagagaaatcttattctgaatcaggaaatcaagagccacttgaaaaagaacataattatggacagccaatgtatgtatgggcgaatgaccacaaatcgattaccgcagcgcgtatctgccagaatgattcaagccatattgagcaggaaacagcagaagcagaacaaacggttataaaagaaccgacctgcacagaaaaaggcagtgttctttggcgtgcggtgtttgaaaatccggcatttgaagcacaggaagaagtggttgaagaacctgcgcttggtcatagctttaaaaatggagtctgcgtcagatgtaatgcgaaaatcacaggacgctggatgaaatcaggttctaaatggtggtatcgctatgaggatggttcttatcctgagaatggattatataaaatcggcaatacatggtatggatttgatgcttccggctggatgaaaacaggatgggctgcttttgataaaaactggtattattttgcaccgagcggagcgatgaaaacaggctggctagcagaaaataaaatctggtattacttgaaatccgatggaaagatggcaaaaggctggcttagagtagacggtgcctggtattatatgaatggaagcggacatatgctgaaaggtttcattacggtaggaaacggaaaatactatatgaatggaagcggaagaatggtaaccggctggaatgtaataaatggttactggtactactttacctcaagtggaaagatggcgaccggctggcagaaaattgataataaatggtattatttaagttcagacggtaaaatggcaaaaaacacctgggtcggaaactggtatgtaaatggctcaggcgtgtgggtaaagagcaggtaaaacaatataaaacaatataaagaagtataaaaaagaaaaaaagaaatcctcggttgctgctgacagccgaggattttctcttatatgattagcctaagaagaagttcattggaacagtaacaatagcagggaaaagtaccatcaataataaaatgatgacttcggctaataagaaaggccaaatggattttaccatgcgttccatgttaattttacctgcaccacatgcaacatttaatacagttccgacaggaggtgttaacagtcccattacagtcattaaaataaatacaactccaaagtatgcaacatcaattccggcagcttttacagccggcagtaaaacaggtgttaaaatcataatcgtaggagttacatccatagaagttccgactaataaaacgattatacagataataaacattaacagtatcggatgattgataaatggtgcaagaataccggttacaatagccggaacatttgcaacagtcatcatccaggatgaaaccatagctgctgcggctaagaacatgataacagaagaagattttgcggcggaaacgaggcagtccattaacatgttaatttttaattctttgtatacaaataatccgattacaagtgcatatactgctgcgattacaccagcttcggttggagtgaattttccacttcttaatccgacaagaataaatgcaggaaggattaatgcccacaagccatcaattaaggctttcaccacttctttggcagactgtctttcagcttttgcgaggttatcttttttggcaatgaagaaccataatacacattggagaaaaaaaagaactgatgaagctgtattcggaattttttgtgaataatgagtaaataaaaatggcgtattaatcccataatttgtgggagttaatacgctgtttttttcgtatattttttgtttgattaacattgagtaaactcagatatcatggtattatatataatattaaacgtgtcggtgaacctgtgagcaagggaaggaagccctttatgattggaggatgatgccatgaaatatgtaattgttgaccttgaaatgaatcctgtttcaaatgaatatccaaacgaacgaaaagtaagcagacttgaaacaattcagattggtgcagtgcttttggatgagaagtatcaggaaattggaagttttgtaacgctggtaaagccagagtacaatactcgtattcagaaacgttatgaaaagctgacagggattaagacaagcatggtagaatctgctccgcattttaaagaagcactgggtatgttctttaactggtgcggcagtattcaggatgaagtgcagattattcagtggagtgagaatgattaccttcaatttacaagagaattgcagatgaaaggaatttcagtatcagaacagaatcaaaagtacatggaacatgtctggttggattttcaggcggaatatgagaaagtgcttggactggaaagaaatatctctttaaaagatgcgattatgtatgccggagaagattttcatggtcatcagcatgatgcactggttgacgcgagaaatacggcctgtctgtttgggattgtaagagatgaagagaaatgtgagaaagcgttgaaacatgtcatcgaggtgttaaagccaaaaacggaagtttcccttggagatatgtttgacttctcgggtttgtcgttgtcggcataagaattaaaaaaagctgcaaagcgcaaagattaagaaatgatatgcgctctttgcagctttttttgacgtatattcgcaaaccaagctgccactcattgcccgagtgacagcttggttacttgctatccctgataccttattctttcaaccagcgtttcctttttcagattactgcttaaaacgcaggaaagtacaatctgcaacagaccgaccaaaaaaatcataataaaaattggtacgattggaacatgatagatattcattccaaatattccaatatgttttgcataggaaaaaagtgcatatccgagcggcagaccaatgatcaaagctacgcatatggtgccaaccgtaaaaatcagtccctgtaactgcaggcataaatttaattgtttattcgtcatacccacagcctgtaatacaccatattcctgcttttttgtcgtaatattcataatcatggtgtttgccatattcataaaaccgatgagtcctacaaccgccataaacagataacagccaagcttcatcatgcgggctgcgacttcggcagattgtaactgtgcatgataggtatccatttttatatgtgaagtattagaaatcaaagtattcagactctgttccacagatgccacatcttttttatcacagtccacccacagatagccataggctgttcctctcggattcatggaacggtatacaccttccggaataacaagataagtctccgcacttacaaaggatcctgcaatctttccctgataggtataggttccacttccattctcaaagtcaaatgcaattgattcacccggagcatatccatcttgttccatccacgtcgaccaaccaaagaaaatatcaccattctttaccgcctgatcatagtccatagagccaatatctccgtcttggcgcataaaatcaaaatcctttttactcacaatagcacccggaaatcttgttccattcagatttacagaaacaatctctctcgtcatgacatctgtcactcccggaatgcttttgatttcctcaatcagcgaatcattcaatggattatccgtcagaatcgtatccagattattctcaggatatctttcatcatactcagcagaatagtcaagctgcagttcaaattgtccatgattaacggaaagacgtgcttcatgctccgtgtcaatatttcccacataattagagataatcacaaacaatgtgcaggaaagccccattgtgaggatggtactaatggttcttttttgattacccgttacatttgccattgccatagaaaacacggtgacattttttctgccatttcgttttccttttttgtgtgtttcagcattttctaaataccgtgttgcttcgataggcgaaatccgtgaaacaattttcattggtttacgcagcgccaaaacaacggtaagaaatgatacgaaaatacatagaagcataacaggcagggaaaacagtggcacctgctgattttggactcccatagagccagtttcggttgatacaaggtttccctgttctaccagccagttaaaaccgcattttgcaatcagaaaaccaagaagcaatccaaccggtattgaagaaattgtcaaaaaaatgccctctctgaagatcagttgtttcatctgcttttttgtcgctcccagagccttgatttttccatactcctgtatcttgttggcaataccgacctgaaaaatattataaatgaccacaacagagaaaagtacaattgcaagaatcaaaaccccgcataccgcaatcgtttcataactcggctgcaagacccattgcaaatagagatcattgactataacgtttttttcttcgatcccacaagttgctgcaatctgctttataaccgaatcaatattattcatagatacatttacagaatcatttaaagtaaaataaatattatactgtctgtcattctctgcgacgtgttcatcataaaactcctgtgacccgaaagcaacataagatgcctcgatggtatactcatcccgatcatataggattccgctgacaacaaattcttccggcttatattctgactgcatccctgcgcggtaatccagtgtaaccgtatctccgatctttacatcaccataccccattgcacgaaaaaatgctcttcctgcggcaatttcctgcattttttccggatactttccttccttcaactcatattctttattataaggaagcatttttcttgcagtctcatccatgcagacaaacccgcctttttcattgccttttatgataccttcggtgcacatagtgcctgtagcatctatttccgcacggaggtttacttcttttaattgcgatccgtctgcggaaacaaacagaccataattgcttccatatgatcctgccgcctgacttttctgtaaatgaattactccatttcccacagtactgatgataacaagcagcatcgtggtcagacagattgccatcatgatcagtatacttcttgtcctgttccttttgtcattgctatatgcaatcctgcttattgtcttcatctgaaatccaccacctgtccgtcctcaatcaccagaatacggtcagcgacctgtgcaatttcgtcatcatgggtaatcattacaattgtctgtccatatttttttgctgtcatcttaagcagagcgattacctcatcactggtcttagaatcaagatttcctgtcggctcatctgcaaatataatttccggacgattcaccagtgctcttgcaattgctactctctgctgctgtcctccggataactgatttggcagattataaatccggttttcaattcccagagttgcaataatatcatttacatacgcttcatccacttttcttccatccagccccagtggcagtacaatattttcccagacattaacagatgaaaccagattaaatgcctgaaaaacaaatccgatttttcttctgcggaaaacagcaagggcatcttccttcatcctgtataaatctttccctgctaaagtaacactgccttttgtcggggtgtctagccctccaagcatatgaagtaatgtacttttaccggaacctgattttccaacaattgcgacaaattctccatgctcaatctgaatgtccacctgattgaccgctttgacctgattctcacctgcaccataaaacttacaaagctgcttggtttctaatattacactcatgtgttgcctccttttcatcctacatccaaattgtatcaggacaatctttcatttcactttcaaaaacgagcagaagtcttacagagttgtaagatttctgctcatttaaaatttaactaacatatggtaattgaatcacaaacgtgcttccttttttctttttgccggaggttaccgtaatcgtacctgcgtgtttttcgataatttctctcgatagaaaaagtccgattcctgtaccactcttttccatgacctccttggaacttcctctgtaaaatcgttgaaaaattttgtgatactcattctgcggaataccaattccctgatcttcaatttccattcttacaagatcgtttcttttttgtaaccggataaatatttttgaaccacacggactgtacttgaccgcattatccagaacgttgatcacagcttcaccaagccaccttttatcctgcataatcgtgcatgtttccagctctttttcatagtcaaaaacgaattcaatttctttctcatccgctttaggataagtgcggttcacagcagatatgacagtatccataagcggaagttttttcttattcatctgaatcagtccagtttccatcttggatatttcaagaagcgactgcaataatgtctccagtccatccagagcactccgacaacggatacgaaactcctcctgttctgtggcacttaagtcattctgcatcagcacactaaaacatatatccaaagctgcaaccggtgtctttaactggtgtgagatgtcagaaaccatttctttcgtgctttctttttctgtccgtgcttcttcctttagcaactgaatatgatgtccgattgcttcaagctggtcattcaatttttccagttctgcatgattttccgttttcagtaaatcatcaaatttattttcacggaatctgatcagaatttcttccaactggtctaaaattttctgatgacacgcatcttcttttttcttccaataaagtaaaaaagtcaaaaaaaacacgcatatcacagtgcttacagcaccggtcaccataacctgatgccggaattgtgaataaaatgcattccctttattcccccagtatccatattgctccaataattgctttccctgttcgttggtttcaatatccttatccttaagcaattccgaaacagcatccagcccggaaaattcttcctttgcagcaatctctgtcataagattcattttatatttataatcttcataaaacacatacgtggtaaagcaatttaatattgcaaacaatactatgacaggcaataccaaggagagtactactgtgatcttcttgcgatatctctttgtcactgccttacctcctgattccatatatacccaagacctctgatattctttatatagaccggtgtagccggattgtcttcaattttctcacgaagtcttctgatattgacagcgattgtattttcatccacaaaatccccttccagatcaaacacattttccaatatttgtgtttttgaaagaatctgtttcggattctgaagaaaaaaagtcagcattttcaactccgtttttgtcagactgatttcacgactctttatcaggactttcatttctcctgcgataaatacgatatctcccgaaatcatctttccggcttccgttttctcctgtctgcgacggaaatgtgcttctattttcaaaagaagtaccgaaagactaaatggctttgtaatataatcatctgcccctgcttcatatcccataacctgatccatctcctgatctagtgctgtaagacaaataatatatgtattataattgcatctcatccaccttacaaattccagtccattcccatccggaagattcacatcacaaatggtaacatccacattattatcacttgcaattctttttgcttttttcactgattctgctgaaaaaacctcatatccggattttttcagtgagaatgtaattccacgatttaaattttcatcatcttcaaccacgagtatatttggcatagcatatgcacctctctttattaactatatatatttaatatcagagtagatattgtttttataacatcacctcaacgtacttcatggcttgattttgatatgattgaatcgttccatcgtctgaatcaaagactctacgttctgaatttcatcctcatccagataataccgcttatctgcatttatcgttctggttaactgcatgaaaacactccttttctcaaaataattcgtcggttaaaaacataacaataattgaaatagtccttgatttatagtataattataacacaaatcaaaccattttacaatgtcggttaatttttagaaaggagaatttatggaaaacaaaacttatactagaaatgctcactcggtctgctgtctgacctattacgctgttttcgtcattaaatatcgaagaaaagtaatcacaccagaaatccttgcttttatgcgtagtcacacagattacttaatttcacagcgttatcatggaacacttttggaatttaatggtgaagaagaccacatccatatcctatttgaacttccgccatccgctgcaccttctgttattatctgtaatttaaagactcagctttcaaaggaagtccgaaaacgcttctgggaacaaattcacaatcaattatggaaagattctttttggagtgacagttacttcttatcgacaactggcggtgcaaatttggaagtattagaacaatacattcaacaacaaggaatcgaaaaacaaaaacggaaatacgttcatcacaagaaaaaatgagcattcatccccaaccgactcgtcggatggggttttctgctctataatagataaatgtataaagattttgcacagttcgtttttttcaaaaaacttattctgtttttcaactcctgtgatataatgctttattataataattcccattgacaaaatgaggtgaaccaagtgaaaaagaaaacacttgtgcctcttatcatttttttactgggcatatgccttgttagtttgattgtatacaaaacagacacccacgaaaaagagcagagacacataacagcacaattaaacgtagccacctatggcgaacaaataaagaatgaaattacaaatggaattgagatcacagataccttgaagcaaatcttaataagtgaagatggcgaaatccatcagtttgaaacaattgcaggaaatcttatgtctgattctattgaaagtgtacagctcgctcctaatggtgttgttacagatatttatccggctaatgaaaatgaggcaggtaagattgatttgattcatgataaagaccgcggaaaaatttcctgttacgccagagacaaccatacaatcattacgcagggtcccttcaaattaaaacagggaggatatggaattgcagtccgcaatcccatatacctgaaagataaaaacggacatgagtatttctggggatttactattgttatcctgcgtgttccggatattttttcagattcaatcagtgcactttcaaattttggatacgaatacaaaatttcaaaaacagacgctccatggagtgatacttataaagtggtttatcaatcagatgggcaaacaaatcatcctgtttcttatacatttacaataggagatgaaaactggaaatttgaagtaagtcctaaaagtggatggagaaatgccactctactgataatcatcatcggaatgtttcttacaataagccttctcctgtcagttcttaccagaatatggttagtagaaaatgaacataagaaaaagtttcagatactggcgcgcacagattctcttacaaatatttataaccgctatggatttgatgaatttgcagaaaaaatgattcaaaaaaatccaaaagcacattttgtggctgcgctccttgatatcgatgatttcaagtttattaatgatatctatggacataattacggagacagagcactaaagaatcttgcagacagcatgaagacttttttcccatccgatgcattacttggaagaaatggtggtgacgaattctgcattcttttaccaaattgtacctttgcagaagcagctatacagctgcagaaattcaccaaacttcctaaatcattctcataccatggtaaggaacatgcattttatatttctctaggatatgcagaatatccaacatttgcatccaatcgttcacagctcatgcgctgcgcagatgccgctctttatgaaataaaacttcatggaaaaaatggatgtatggtctacagagaaggaattcggacaggtgcccgcaaacaacttggattcgcattcaaggatatctctgaacatcttccaggtgcattcatcatatacagagctgacaaagaagatgatgaactattttttgcaaatgatgaatttcttcatatgtccggatataaagatatagatgaactgttcagacttactgagaaaagttttcgcaacttgattcgtgaagatgaacagcaacagatagaatcaagtatctgggaacagattgacaacggcaataaaaatgactatattcactttcatcttcgaaaagctgacggaacttatttttctgtgcttgatcatggaagaattgtagagaacccgcaatacggaaaggtattttacgtattgttcatggattggaaagatatgcatattcgttacaatgataaattcgcaagataataaaatattgcaaaaaaagagagcgtatgatctattttcatattaatacttggtttgaaaactgatggaagaataacacgatactgcgatagaataaggaaaacggttaaactaactattgctgagtgagcaacagcaaaagtaagcatgactggaaagtgcttgtgatcttagggattaagagaggatacagattatggaagattcttacgtattacaactgttgaaaccaaagtttaaagattttcatttgtgtttctgcggatttgcagaatgcaagccattacatagctacgggccagccgcaaggtccaattatattttgcattatgtaatgaagggcaaaggtatctatcaggtaggtgaaacgaagtatccgctgaaagaaggacaggcctttctgattgaaccggaaagccttaccttttatcaggcagataaaacggacccatggtcttacctttgggtaggatttggtggtacggaggcacagagatttgtcagagatctcggactgaacagtcgtcagcttacatgcgagtgtgaatatggagaagaactgaaagaaattgtatttgaaatgctttatcatacgagttcaactgcagaaaatctttattatctccagggaaagctctatcagtttttctcagtactggctcgcgggattgaaattcagcaatatgcggatgatacaaaagaaagtatacatgtgcagaaagcaattgcctatataaagaattactattcacagaaaatcacagtggaagatatagctgattatctggcacttaaccgaagttatttatatacaatatttcagaacagtcttggaatctcgccgaaggattttttgacggaatttcgaatttccagaggaaaggagcagctcgcacttacagatctatctgtggaggaaatcgcagtttcttgtggttatcgcaattcacttgctttcggcaaagtatttaaacagaaaatgggaatgacgccgacccaatatcgtaatgataacagaaaggctgaccgagaacgattgatcagtgcacaaaacgaactgaaagaatacaagaaacataaaaaaatttatgtaggagacgtcgaaaaagaatagacgaaatgttgaaaaagacatccgatacctaacatttgggatacaacacttaacaaaaaggtataacggatgtctttttttgtacgctatacttgtatcaacaaatataaggaacaagtgcacaggtttcttcactcaaataacaaataaacaaaggagtattggaggaggagaatcatggaaaatcaaaaagaaactcagaaaaatccgcaatataaatatgtgtctacaagagaaaaattatgttttggaattggagcaatcggcaaagatgcgatttgcaatttagtaggagcatttttaatgctttattttacagatactttatatttggcaccggcatttgtcggcgtactgtttttggtagcaagaatatgggatgcgatcaatgacccaatgatgggtatgattgttgacaatacacatacacgttttggtaaattcagaatctggcttgtaatcggaacattagtaaactcagttgtatttgttttattattccacagctttaatctgtcaggaacagcattgtacgtatatgtatctgttatgtacattttatatggaatgacttatacgataatggatgtaccttactggtcatggcttcctaacctgacaaatgacccgcgtgaacgtgagaaagtttccgtaattccaagatttttcgcaagtcttgcaggattttcagtagcaacatttggactttatattatcaattacctgaataaagttgcaggcgagagcaatctctacgcagaaaaaggatatacactttttgcaattattatcgcagttattttcatcgttacaatcggcattactgtatttaatgtaaaagaggaatcaacagtaggtatatcagcagaaaagacaagtctgaaacaggcatttcatgtaattgtaaaaaatgatcagttgcttgcatttatcggattacttttgacatttaacctttgtacacagattgcaaaaagctttgctgtatattatttcaaatgtgtatgccacgatgaatatctgtattctatctttggatttgcaattattgctgagatggcaggacttttatgcttcccaaaaatcgcagcaaaaattaaccgtgaaaaagtatacgcatttgcatgtggacttccaattgctggatttgtactgctcggtgcagcaggatatgtagcaccacagagtaaggtgttagttgttgtatgttgtgcactgcttttcttcggatcaggtctttcacttggagtaacaacatgctgtatggcagacgttatcgactatggagaagtaaaatttggtgtacgaaatgaaagcgtaacatgctctgcacagacatttcttatgaaggcagctacggcagcagcaggtggattaacaggaattggtcttcagattgtaggatacaacgcaaaagcggtaacgcagagcgcagcaacagtaatgggtattcgcgtgttaatgattgtaattccaatcattcttgcatttgccagctttggtatttacaaaaaatactacactttaaaaggtgagaagatggaagaaatcacaagaaaagtaaatgaaatgcatgcgaaaaagcagacagcttaagagtcaacaattcaattataaaaggggtagtatatgagacagattatttttcacgaggaaacgaaaactttccatttatacaatgaaaaaatcagttatatcttatgtgtattagaaaatggacatctgggacaattatattttggaaaacgacttcatgataaagcagatttttcttatctggttgagaaatgtgaacgcccaatgacatcgtatatatatgagtgggatcgtactttttcattggaacatatccgacaggaatatccggtttacggtacgacagattacagacatccggcaattgaattgttgcaggaaaatggcagcagaatcagtgagttccaatatgaaagctatgagattattgccggaaaaccgaaactctccggattgccggcaacttacacagagtccgaggaggaagcgcagacattgcgcatctttctgaaagacgctttgactggtgcaaaactggcgcttttatatacgatttttgatgaatatagtgcaattgcaagaagtgcttatattgaaaatgccggtgagaaaaatctgcatgtattaaatatgatgagcttaagtctggatctttcggataaggattatgaatggatgcagttgtccggtgcgtggtccagagagcgctatattaagaatcgaacattggagcaaggcataacagctatcgacagcatgcgcggaaattcttctcacgaacataatccgttccttgctttaaaacgtcacaacacagatgagaatgcaggagaagcaattggaataagccttgtatatagtggaaatttccgtatgcaggcagaggtagatacacataatgtgacacgaattacagccgggatcaatccagaaggattcgattggaaattagaaccaggagaaagctttcagacaccggaagcagttctggtttacagtgaaaatggattaaatggcatgagtcagacattccagaagctgtatgcaaagagactcgcaagagggtattggcgcgataaggcaagaccgattttaaataacaactgggaagcaacttattttgactttacagaagatcgccttgtagagattgccgggaaagcaaaagaatgtggagtagaactgtttgtcttagatgacggatggtttggtgcgagaagaaatgacagagccggtcttggcgactgggtggcaaatgaagagcttctgccaaatggcatcaaaggtctgtcagaaagaattgaagcacttggattaaaattcggcctttggtttgagccggagatggtaaataaagactctgatctttatcgagcacatccagactggattttacagacacctggaagaaatacatcacacggcagatatcagtatgtactcgatttcgcaagaaaagaagtagtagattatatttatggtatgatgacaaagttattatcggaatcgaaaatctcatatattaaatgggatatgaaccgaagcattacggaatgctatagtagcaaacttccttcagacagacagggagaagtgttccatcgttatattttgggtgtatatgatctgtacgagcggttgacaaatgagtttccagaagtattatttgaatcctgcgccagcggtggcggaagatttgatccgggaatgctgtattatgcaccgcagggatggacaagcgatgattcggatgcaattgagcgtctgaagattcagtacggaacttctatgtgttatccgctcagcagtatgggaagccatgtgtctgttgtcccgaatcaccaggtatttcgcaatactccattacatacaagagcgaatgtagcatactttggaacttttggatatgaactggatctcaacaaattgacagaagaagagatcaaagaagtaaaagaacaaatcgcatttatgaaagaatacagagaagtgttacagtttggaacattttatcgtctgaaaagtccatttgaaggaaatgagacggtatggatggtgacaaatgaagaccgcacgcttgcaatcgtaggctactatcgtgttttaaatggagtgaatcagccgtatagccgtgttagattacagggattggacccggatatggtttatgaaaatgtatggaatcatacagaaaattacggagatgaattaatgaattatggattgatcacatccgatgtgacagctggtgaagtgcctgggaatgtgactccttgtaccgattttgaatctagaatatatatgctgaaaggcaaaaaagttcaggagggaagatagagcatgacgaagacaaaaagaatcagtggaatggtactgggaatattgtttattggattatgtgtatctttcttacgactttcacaatttggcgtggatccattcagtgcaatgaatctcggaatcagcggatttatcggatggagctttggaacgtggcagttgcttgtcaatgcgatcattcttgtagttgtattctttcaggcaagatcctgcattggtgcgggaaccattatcaatatggtatttgtcggatatattgcagattttatctgttatgtagcaaatgatgtagtgcagattcagatgaatctgccactgcgtatccttgcactgctgattgctcagctgatggcatccatgggagtggcattatatatggtcgcagatatgggaatcgctccatatgacagtgtcgcaattataatcgagaaactgacacatcaaaaaatcccattccataaagcaaggattctttcagatgttgttgtcgtgattatcggaatcatatttgccactgcatctggggcgggaatctggtcggtagtagggattggtacaattataaatgcctgcttcaacggtccattaattcaattttttaaaacaaaactggagagattttacttgtaaaatctaaggattacaattctccaattcttgcaaggctcatatccagaacggatacgggcctttctttttcaccagtagcttcatccaaaccttcatattgaataatgaacccttctctttggtaaaaagaaattggatatcttcctcctatatgatacatataacagcaaaaacaaaacatccaagagacggaaggagaatatgttatgaaaaaaatattagtagttttattatctctcacattaatatttgcttttacaggatgcacttcatccaataatggagcaacagaagatatagaaattaagacacaggaagttgtaacatcaaatacagatgacaatgatgataatatcagtaacacagaaaacgcagtagagaatgcgaacgaaaaggattatgatttctcttcttatgaaaacgatatccgtaatataacaaaaagtgtaaacaatgcaaaaacatctacaaatgcatctgagaatcacgaacaattctacgctttgaaaaaacaggtagacgcagtcgatgacgaactggataagcttgacgatgaatttgagtatgcttaccagatgaaagagattagcttcgagacatacaaagcgagagaacgcacgattgaaagactggaagatgaactggaattagcagaagaagcactggaaaataaatacggaattgatgattaattccatatcgacttcttcagaaaccatatctgtcagggaataaccagaatcgcccggcacagattttatatcaccttcttgaattttacttggaatggatgcttgcgaaatgctttgagtcgttctactatggtttcgactttccagttactttttatcttttcaattacgccggagtaaacaaattaattcgattactaacacaagtgatagtggcaccatatgaataatcgggtattatgaatataacataatgaatagaatattcttaccggggaggcgaaaaaatatggataaaaaaaagaatgaaaaatgggaaattgtaggcgtatagctgttatttattattggattggttggatgcatcttctgcatattcaatgaaattaataaacaaaaagagtttgaaaattctactgatattcgaagtgtgagtgcagttattactcaagcaaaagaagataaagagtctagcaggataataaaatatgatgttaactattcatatgaagttgaaggggaaacttataaaggaagaggcaccgtttatcacagagttaaaataggagatgaagacactataactgtttatcgaacttcaaagggtaaatataaaatagaaccaatagacagtccaatcgagattcttatagctactataggcgctgtgctttgtatatttattctggtagctatgacggttggcagaatattggaaaaacgagataaagagaagaacgaagaatcggataataaagggaagaagtcaaagagaaaatagtaaatgactaagagaagaggatgtagaaattggggagattatccggggcggacagtctccctaattatcatatagtagttttaatgacggagacattatattaaatacggacatagccggtggatggacctgcaccgaccttattatcaatcaccgtcttaattctatccggcttggaaagattatggtacttcaaatgctctacacggctttcaaattcattgtatgctttcagtatgatacccagataatatttaacaaaaggctcataactgttttcgccctcatgccagccagtagaacttgcttgaagagcttcataatatgtttcttttgtcttttcaatcagcatttccatactgacatattttccaacgatatatcccgccttataaaaaagcagtaaagtgagcaaacggctcatcctaccatttccgtcattgaaaggatggatgcacagaaagtccagaatgaacataggaatcaaaaccagtttatcaatgcggtcagcttcccatgcttcaaggaagcgagcgcaaagctctttcatcgcttcagcagtctgaaatgcgggaactggaataaaacgtgccttctgatggccctcgacatctatttctgcaattacattatcggaattcttataacttccaccagcagccccctgtgaataggagtacagatctcggtgtaactgcaaaataatgttcgattttggattgatatattcatagccttcgtgaattgtggaaagtacctcacgataaccagcaatttcctgctcagatcggttgcgtggctctgctttctgacttaccagttctttcaaacgtttatcacttgtaaatataccttcaattcggttagatgctcccgtactttgaattaaagcaacttcgcaggatttgtaatataatcaaaatttctcattgaaatctccttcattttgaatttatctccattattttaatgctaaatgatggagatttcaatggatttgatggagatatattctccatatgcacaataaatatattaatttggatatagaatttattacttcatcgtcttcgccagtgaattgagtaacgcccgcatctctggatttgccaatatttttgccagaagttccggatcgacttcatcagcaacagtagtattattgttttcctgctgactcctaagatttcctgtaactcttgaactgtataacatcttttttctgacatttctttatcctctgttctttgaaatatgaaagaaaaattatcccttcatataacgaaacgctcagagcatgttttacagtggtcaaaagcaagttttttgagatttctgcatttttcctgaaattaagtaaagaatcaggttgtctttacttaatttccactttcaaaaaataaaaaaattttgtttttgaaagcggcatcttgcatatactattagcagacagtatatggattatgacagagtatatgggaatttgaatccatacactctatgatttcataaacttgaatttatcgatttctttattatctaatctgttagtaatctatccaacagcatctgcctattatttataaatatttctgttacctggtaactctctgtatcctcatattcgcacagatgtatgcgtccattatcaaaacaatagatatctgcatctggtattcctaacaaaattggcgaatgcgtaactataataaactgtgctccctcttttgcacatctgtatatttgcatcaacaatgtaagctgtctctgcggcgataatgcagcttccggctcgtcaaaaagatacaagccatttggattcatattattctgtgctaatgcgagaaaactctctccatgtgatttttcatgatatttagcggaaggatgtgtaatatctgcatattcttcttcctgcgttgcaacattataaaagctttctgccctaagaaaatatccccacttttccttccgatagcctttggcaattcttatcgcatcacacaactctgaatgtgtatcatgcgtagaaaaaacataattcttcgttccaccctcaggattaaaaccatgtgctacggcaagtgcttccaataaagttgatttaccgctgccattttcccctacaaaaaaagtaattggtttgttaaaatcaagtttttcaactcccttaaaagccctgatttccttcagataactatccttatcaattttatcccaatcaaatattactctttgtatgaattgatcattcacctaatcatctccttgtaaaaaacactttctaatccccatcttcttgtcctttagacaagaagcattcttcaccttcagttcggtcaatcccgatttctatttttgtttccatagcatggtgtactctttttcaccagtagcttcatccaaatcttcacattgaataatgaacccttctctttggtaaaaagaaattgctctggcattcttctggtatacatttaatcgtaagctaacttttttatccttaatataatccaataaaagtttacctatgccacatgactgcatttcatcagagacaaaaataccttcgatatattcatcatttagtcctacaaatccttgtatctttttatccgcttcaaacacatagatttcggattgtaacatcatttcttttactagttcataattacttttccagtattgattggaaataaaataatgtgctttcagatttgtctttaaccatatgtcagcaactctatcaatatctccgttcagcaactttctaatcataaccaatattctccccaactacatcctttatgcttttctctttttttcattctatcacaagctcaccattaatcattatttttttgatattttttcttttcccccactgcaaaacaggctctgagcgtttcgttatatggaggggtacatatacagagcaagatctacccatgtattaccgtatcgccattttatggctacggcatacctccgggtaagtctcttgacggggattccgattccccataccctccttgtacagacatcaaagatatctgtaggctctctatcaaagataatcgcagcactttatataaccggaagggacagccggttaaaaagtgtaatcgcacatccaagatgtcttatctaaaaggaaggaggactatggcacctaagaagaaagaaaagaatctcaagagaagtaacatcatcacattaaaactaacggatattgaattggcagtgttaaatgaagctgctgactgttttatcagaaacattcagtcgttcagccaaatccttttgagtcattccattgacttttcgtaaagcggcaataaaaccgccgatggttttcttttccatattgagtcctccttttggataggtggtttgctttctacgtctttattctaagattttagtagtgagaataccacccaatagactcagaatcactctcagaatccgagaattgactgtttccaggcacaaacaactcaaagcgacttaaaatgccaagctattcgcattcaacaagaaatactttattcccatgatgacaaaaccttcatcatttctccaaggcttcttactgccatttacaatgacaatcttcttaaaagagtctgggatattacgcagagaattaaactcctgagtctgcttttcttccgaagtcatgtcataagcaacctgaatgtaatacctctggttgccttggttcaccacaaagtcaacctccagctgcttacgaacacgcttgccctctttatccttatcgaagatgtccacgacacccacatcaacattgtagtcacggatcagcagctcgttataaacaatgttctccatgatatgagtaggctcctgctgtctgaaattcagacgggcatttctcagtccaagatcagtaaagtagtatttcagatttgcaccgatatactttctgcccttaatatcgtatcggcttgccttggaaatcaaaaaggcatctgtcaaatggtcgatatgcttggagatggttttattagtataagtcatctggcgctcactggcaaaggtattggcaatctttgaagtacttgaaacacaccttaggatctcttagttcctcattttcaataccatccaatgcaatctcaataatatgatcagtatcaacatcattctccagtaagtatctcttaaagatagtaaacagcaaaaaggatttgccacatctacgaatgccggtaatcacctttatcattccattatcttttcgctcaatcagcctgctatatcgttattatagttaagctgaaacacggaggagatttcaaaggggcactatctttttggagaagtataagtgatgcttttgtccaaggaggtttcttatgaaaaaatgttttctttagtcctttgcactatccttactcctttctttgtctactactggctatgcagcagtaaatgatgattgcaacaatatcactattgacgttttgaagaacatttttattatgacggagattgtagaacagaaaattgtatcaggttgcaaaaatctttcctgagatcaagtaaagaaaaagagcatatagatgaaccgccccccagaagttagacccaaaaatctaactattggaggtcggttcaattgtaggctctttttttacattccaagagttttgatcactacctgtgccagaattctggcaagataatcattggggtgatttaaccagtttccggttatatcaatgtatcgttttctctttccgatttctttttgaactgcctgtatatctgctatagcaactcccataccttctaagcccttcagactttcactgtattcatcctgatgtgcccagaaatggtgtggctccgtagcagccagttcattgggaagcgtagacgcaatcaataaaaattccgttttcggactaaccttccggattgcctctatgagtctgcctgttttatttctgtattcttccataccgcaacggtcattcattccaaaaccaagaataaccagatccggatggaagttggctgcacgctgtgatgaattttcgattgcccattcggaatccactcctcctaccgatgtgttgtggaagcatactggactctgccatttttcctccatctgatggaacagcagttctgcccaggtaggctgtcccggcttctgtccatacataccgctgcagtcacagccacagcacacgctgtccccatacaaaacgatcttaacgggttctcctacttccagctttgcagagagcttcggcagtttgtccagttgactttccggagcggaaagtaactccttcttcgttgccttataggtaacggcgatctgtttctctgtaacaagcttcggattgcctatggcacataggtttaagaattttccgttggtagtcactagcggaccgaaatcttttgcaaattcgcttgtttctcctgccttctttgccgtatcaaagtccggataaaggaaggtatcccatccggttactggtatgtgactcccttcaggaattaccagctcatctccctctacaaggtaatcgatccccttttcatatactgtttcccggtcatagctttctacggacaaaacttcttttggagtccacaggaaagaagccctgcatccattctcatcagcaactgctgcaaaggtttcccggaagcaatactcaccttcccatatcggctccagccattctttatggaaaatctttcctatcgaaagggttttcttgatctgttcttgtaaaaattccttaaagggtgtcacccatccgcagttcactaccggtctatctgacatgaagatcatctcacagggcttttctttttcatatggataccagtagggcattggttttccgtccgcatcattgccgtttggatcacctgtttttatgaaattcacccagtaattgcacatcattctggaaagatcgtaatgctgcccaacaaagggtctccagcatttcgccagtgtttcaaagaaaaaccataaatctacagaatggaaggttccggcattatcccatcctggaatatctggatcaaacctgtaataatagtagggctttttttcacctgcactttttttatctgaaaaaagacacttgatcgtacattcaattccgtttaccttcgcatactttccatcagaatcctcccgcattgcctcgggaaagcgcaaaaaggtctcagcattctttccgaaaatctcttctgccttctttttcaaatcttcttttgaggaagcttctatataactgggaaattcatctgaagtatttccagacataacgggaacatttacatgcttgccttccatgaaaagaaccattgggtcacctacacagaacttgtgatccaatacggtaaacatagccggaaatattttggtatattcctcatacttgtcacgaatcgtagccgcatccagcttacgagcctgctcaatagttgagcaacccaggaaagaaagaaaatgctgtccgttttcctcagcatgccacaattcctccggcactccgattcctccaacctgataaggagagcgaatcattgcactcatcactactgcacgatgaaataagcctttattattcatacatgccatctggctcataacacttccgcctccggctgactgtcctgcaatggtcacattacccggatctccaccaaagaaagcaatatttctctgtacccatcgaagtgctgcctgctgatctagacttccaaaattagtcggtgcgtcagggtgctcctctgtcagctgaggatgtgccaaaaatccaaaaacattaactcggtagtttaccgttacaactaccacaccgcgacgtgcaattctctctccgtcaaattccatttcggcaggatatccacactggagtcctcctccgaaaaaccataccaaaaccggctgtttttctgttacttctttagcacctgtccatacgttcaaatacagacagtcctcatccatggcaatttccggatccacatgccactcacggatatacacgttatcaccgattcccgggacgctctgcatggaaatcggagcaaagcgatagcattcacgaactccatcccagtcttcacagggctggggtgctctccatctgttttctcctaccggaggagccgcaaaagggattcccttaaatgcagttatcctagggtctgcggcttcaatacctttcacccatccattttctgtccgtactgttctcagcataattcctacctccgctaattttactattagccatgagcaaaactccacatactcagtatttatgcatgtttgcgaggcatggcaacctctctcaatgacttataagttactacagcacatgcaataacatagattatgataactcaaatgatcttaatgcagcatttccgttaccgcgataggtcaggtaaagcgcctgtattccatccggaatcgtaatcggtgcggtatatttttcccagacattggtatattgaacctctaatgtcgccagtacctctccatcccatgctgtctttacttcaaaagtgccatctgcatagccccggatccaaatactgatttcacgaatatcatggcagtcaaaatatttgaagccgatagtagttgaatctgtaatattggcaatatatccaacttcttcgtctccatccctgccgtcctgcattactcgtggaaaattcccttcgcccacataaactgatggggtatcggtaaacagattacatgcaagataagcggggtattcgcctttaccctcaagcggacctccatttaaaccgcaggaggtaatttttacctgtggaatactgccgtccggcataatctgaagcttttcagcacatccctgtctactgtaccaggtattattggtatgcctgtgataaaaaatgtaccagtcctctccgatctgcacaatacttccgtgattattggcaccgtaagctgttggcatatctgccggcttgtaggtatcgatgtgcagatcacaattgctgacaataactccgccatagacaaagtccctagtaggattcttgctggtggcataacataattcgtgcattaatatggatgaatagacaaaataataggtgtcacctactttacggatggaagatgcctcaaaaaactcatgtccctcaaatccggtaccggcaccatattcacagccggggaccacaaacaccggagcttccctgatcgtcaacatatctgctcccaacaccgtagccatagctccggtacgggatttatcaccttttccgcaagctccggtataaatatatgtcatatctccttccgtcagaacccccgggtcaaactggggctcatcaccttccttttcgcccagacgtgtgccatcttcataatgaacatagccataaaattcatactttcctgccggagtatcacatacagcaactgaaactaccgaaaccttgtccaacacgtaataaagatagtaccttccgtctggtcccaccgtaacatccggggcatacagacacattttgccttccgggttcagcggatcggctgtcttcggataaatcacaccctcatatctccagttgcccaggtcatcgaccggagctgaccagcacacatagtctcccatgcagaaaacatatccgttaaagtaatcatgggatccgtaaacatatacgcgatcgccaaaaacataaggttctccgtccggaatatactcccaggacggtaaatatgggttaaacgcttgttttttcactttgatattctcctttgcaagcctaattcatgtacattgtttcataaagcaaattactgggtgctagtttaagccttcaagctgaccacacgatcatagtcatatcctcgatctggattcacctttccggcattcagttcgaaataaaccacaccgttttcgtttacaggaagctctacgcagatatttccgtcctcctgctttttacgctctgtttttacaaaaggtctggatgattcccgaatcagcttcgtctgttcctcactcagattggcaggttctcccatatcatgccataccttcaagggattacatgtttcctcatctaccgtcttagtcaggaagcagtactcctcctgttcagccggaaatgtaaactccaacagcattttttctttaccctgttctgtacttttacgggcaatattccaggctacacctagataatcaccgtttgcacgtttcaaaacgacaatattgtcatccttatatacacaattggcttcactttcctcaagctttttgtaaaaagcaaatgtccagaaggtcggcttggtaatacagccattggcaaccagtccaaagccgccgtggaatggtgtaaaaggaactcccagctcttcaaacacatcaccaaatgtccagtaggaataggattcattcacatctcccaatctggaaagctgctgtgctataaaggccgcattcaggtttgtgtcatgaatgacgccctgaggagtataggagctgttgaactccgtgatatgaatctgcagacccttatattccgggaaactgtcaataatatctctggttgtttttaaattggcaaagccgtcctctgcattcatcagttcagaatatgcataatgtccaatatattccggcggatcaacggtgtaatgatgtctggttacgaaatccacaggtatgtgattctcatggcaatattccataaatgcctgaatccatttctcatccgttcctccacaaacagcagggcctcctacacggaatcccggattcacttcctttatggcatcaaaggttctatggaacagcttaaaatattcctgcatatccgcattttcccagaagccgcaaagattgggctcgttccatacttcaatgggccattgaataacttcctcttctccatagcgtcccatcagatgccgcagcaatgaacgcaccatattacaccatatatcataatcttttggaggagtggtatttccctgccagtaaaagatagtctggcttccatttgccaactttttaggcataaaacccagttcaagaaaaggtctcagccccaccttcttataggcatccattactctatccagataagtatagttgtactcgacccttaccttaccatcctcctcataggtctgaaagattgccatatcatcacagaataatccatgtccccggatatgcttaaatccgatttccttttgaaccaagcgcagctcctcctgatattcttctgtcaatgcaagccccattcttccggttcccacacaataatctacattattgtgaaaaaaggcctttgaatcctttgtaatcacgatcttttttctgtcatgctctgttgccccaccaaaatttaccatgcatgtatctccttcttctaaatcatgttcctatgcagtcacgcatcagatgtctgaccgctgcacgatccgcagctctctgatgacgattgccatattaatatgatactatcgcattgatttaaagttttcaatgatttatactataagaaaattgatatatcctctgatgtatcagaacggagattccagatgactgaaattgaatttgtcggctacagtgccgttcacccctcagattttatatatgatgttccgaatggctttacaggctatcttctgcttcttttcgactctccctcggagctgctcatagacggaagactaatgcggacagccgccaattctgctattctgtatacaccaggaagcaggatttattaccgtgctgccggtgaagaataccggaatgactggattcgttttcgttccgatcactccttcgtgaagctgtttccgttaacaaacaccccatttcccgtaacagatccggaatactgtcatcagctttttaaattactaacctgggagtccgcctttttctcctctgaaagcgaatcaaacattactcacctgcttcgggttctgttctccaaattaagagaaggaatccagaatgagtccccgggtattcacgagcatgagctggttgcattgcataagatgatctacaataatcctcagcttccatggaatataaacatgatggctgcgaagcttcacttaagtcccagtcatcttcagactctctatcaccgcaaatttggctcctcctgcatggacaatgtcatcgaaggacgtctgcgccgtgcaaaggatttattagagtacagcgaatactccatccgcgacatttccgagcaatgtggttataataatgtagagcatttctgcagacagttccgtcagcataacggctgtacccctggacaataccggaaaaatgcatcagcgggaagcaacaaaagacttctcacccacaataccctgggaggaagggagtttgagaagattaatcgaaatcatccggttgcagaatcttttccggttctgtgacgtcttgataccggacatatcgggatgaatcaacagtatattctttcttattaattttaaagttcgggaaggcccattccataagccttctccaaagtgactttttctcctccaacatcatcaatattttctgtaagttcttctccaccggcatacattcttccaagaccgcataaaattttatcagaacatgtataaaaatgacctgtaagtgacattgattcagaaccgtcttgagtacactgtcaaagttgataacaacacatctgagaacctgcagtccgctgaatcccgtatccgtgatactgatatggcagatgagatgacaagattctcgaaagagagcagcaggcagctacttccatgcttgctcaggcagaggatgaataaaatcttctttttcttctttttcccattgcaaatcccacattttcctgtatgatagagatatattaacaataaggaggcatacagttatgttgcagattaaaaatccggttttgccgggatttaatgcagatccatccattatccgtgtggatgatacatattacattgcgaactctacgtttgagtggtttccgggagttcgtctgcatgagtcaaaagatttagtacattggaatcttcttccatccgcattgtccacgacgacattgcttgatatgaaaggaaatccgtcatcgggaggtatctgggcgccggatctttcctatgcagatggaaaattctggttgatttatacggatgtaaaagtaaccgaaggaccgttcaaagatatgatcaattatctgacgacggcagaagatatccgcggaccatggtcggatccgatccgtgtcaatggtgtgggatttgacgcatcgttgttccatgatgatgacggacgcaaataccttgttcagcagacatgggatcatcgcgaataccaccatgcttttgacggtattacagtgacagaatttgacacagagacaatgaaattaaaaccggagacagcacgtacgatctacgccggaacggacgttaaactggttgagggaccacatttgtataagatcaacggatattattatctgtttgctgcacagggtggaaccgtttggacacatcaggaagtagtagctcgttcaaagacgttagatgcgttgagttttgagacagagcctggcgatccgtttattacaaactttgatacgccggaacttgagatccagaagcagggacatggtgctctcgtagagactcccggcggtgagtggtattatgcaagtttgtgtggaagaccgtggcaccacgaaaatgaaagttcgatcgacccacgcggctggtgtccgcttggccgtgagacggcaattcagaaagtatactgggatgaagaaggctggcctcgtatcgagggcggacatggcggaaaagtgcttgtggatgcgccgaaagatgcaatcttgacagaagcaccggcagatcattcgatgcatgatgaatttgacacaccaaaacttcatgatgagtggaataccctccgcgtaccatttaccgaggaaatgggtacgacaggggatggcaggctgacattggtcggaaaaggatccctctgcaataagcatgagctttcgttggtggcaaaacgctggcaggcatttaactttgatgccgaagtgaaagtgaaatttgatccgttcaactatcagcagatggctggattgacaaatttttacaatgataagcactggtcattcgctttcgttacgtggaatgagaaaaatggccgcgtgatcgaagtggcagagtgcaatcgtggcggatatcgttcgttccttcgcgacgatgcgattccggtaccggatgatgttgaatttgtatggcttcgcacaaaagtaagaaagcagtcttacagctacgagtattcctttgacggaaagaactatacagagattccgggcacactggatgctgctgtattgtccgatgattacgtactccagtcatacggtggattcttcaccggagcatttgtcggcatggcatgcgtggactactccggatacgatcagacagcagaattccgcagttttgactataaagaactggattaatcaatagcaagagccttttttaaaccaggctcaatcagatggctggcgatgccgcagaggattctgggaaaaaggacgaaaagtccgggaaccaggaagacgatgaggcaggcgccggccattgtaaataataagatgaaagtttctttgatgtgaccagccatcaggcgcacggagagcagaagaactgccggaaatgaagcgcgcaggtgtgagatcacggcaaagatataattggcgagaacctagaggacgaggcagattaccatccataaaaagggcggtaaaagattgccgttttttccggtaaagacttgggaaagatctaattcatagtcaaaccgaggcctccttgtgcttagagcatatgaagttttagctttgtcttgtagtttacgaatatccgaaaatcaaaaaagccctttgagaaaaggatttctcctctctcaaagggaaagttggcaaacttgaatttctatttgtgttgccatgtcattacataatctttttctccggtagcctcatctaagccactatgctgaatctcaaattcttctctcttataaaaagatattgcccgtgcgttcttttggtatacgttcaagtacaacttattccttttatcctttgcataattcagcagaattttacctagaccctgcgattgcatttcaccagaaacaaaaatgccctcaacatattcatcatttaaccctagggttaaacttaactactattttttctttgcgatataaaatacataactgtaataatctactactaatctaaaataaagcgattataagctatcctttttcctgtgtttgttttaaagttttcatctatacacttttttatcttttcctgttctttttctttatccataaccgttaaattttcaagcaaatcagcttcccattgtatttgaaaatcaagtccatcaattttagatggagtatgatggttgcctattataaagcatattctatcaatatttttgttatagcctaccttttttaatatttctttcgctacttctggtccttccttttcttgatagacaccatcaatagaaccgtattttttttgtgcttcaaccgcaccaatatcatgtagtatagcaataatactgatgaattctttttcttcctctccgatattttctcctttcattatatcttctgcatttttcaaaactttgagagtatgctctatgccaaaaggaatttctttgaatacttctttcatctctataataattttttctttaaacataaattacctccatttataccttataggtgttttagttctatctatccacttttttgttcgccgatacaatcagcatcatgggacggcgcatttcatcctgcatccccggaatatccatcatgtattccggtggctgcggctccacaatatgatttattataaaaccatttgaaagcagtgtatttagatatgtggtcagtgttctatgatattttgtaaccttttctcccaaaaacacagctgtccgtttgccctcataataataattatccaccggaaaatgcagtatttctcctttttcgttataatgccagtcttgtgttccataggcagtaaaaacaggatctatgttttaccttcccaacttctaattttttacatcatatcccaaaagccttgtcgtactcaataactccatttaatttgtttttacttccgttaagattaagtgccataaaactttcatcgtcaacttcaaatggcgcttttattccacactcacttgccggaatatatcctgcctttggatagtatttggaatgtcccaaaacaactgaatattcatatcccaatttatgtgctatactgtgtccttctttcatcaaagataatccgattcccctgttctgataatcgggtaatacagaaagaggggcaagcgcaagaacctcaaccccttgaacaactgcttttgtaaaaagaatatgtcctacaattttttcgtcctcgacagcaacaagagaaagttccggaataaacgatttgctttttcttaacgcagcaactaagttctgttcatttccatctgtatattcagcattttcaaatgcttcttttacaacatgatataccgtatcataatcttctggtctttcttgtcttataatcaaaatagatacctacatagttttaagctttttacaattacaggaaatggcaaatctactatctacctctcaatttttatggctctgacaatgataatatccgggatttctttattaaaatagcattcttcgtaaaatccatctatgacaaatccggtatcaaaacacagattaaaaatatcctgtaaagaacgatgataataacattgtttttgcggctgtccttcaatcgcaatatcgtaatagctgtgcggcgtcatatatttttctgtaagcgttacaaaacaggggtgctgtgtcgcaaatacaaatactccgttatcctcaagcaatttataaacagaggtaaaaagcggcttaatatcggtaatatccatgaccgccatattggagactgcttttgtaaacggcttatttctttttaatgccatcagacttgtttcattcgtggcgtctgctacacaaaactcaatgtgatcagcataccgtttttggcgcttttttgccagttccaccattttctcactataatcaaaagccaaaacagagacagctttttctgcaagatatgcagaataatttccatttccacaggcaatatctaaaatatagtctgttggatcaggatttagaagctctgttactttggggcggacaacttctctgtgaaaatcatttgattcatcccccattgcacaatcccaaaattcagcgttttgattccagattgctttactttcttcctttgaatactgcataatatcatctttctgcaaaattactttttctccttcgccccatggctcctgaaatgcgtgataatgatgttccaatatttcatctgttatcacaaacggcgaattggcatttaagacctgatttcttttatatagtcttttttgcaaaagctccttactggctttcatatagacaagttccgtttcagcgcctgctttttggatcagctctttataaaaattccgatttctcagtttcaaaaactggaagttataaacatctttgcaaatataccatatctattaactgtacaccacactcataaattgggtggtcataattgtccgtaaagaaattcggaatattgtgagatcggacaaatccgcatttttcataaaacggtacggtcaacgggctgtcacctgttccaacctgcaaaatagaatattcatctgcatatttacttgcaaggaagtcaatcaatgctttcccatagccctgtccttgattctgaggatcaactgcaatatttttaatttcaagtattccattatcttcatcagtaacaacacattcagcttttacattaccatcttcaagtacatacatagtacctttttcaagatagtgatcaatcatattttcctgctcatcagctaataacaataatgctataaattgctttttattctcattcacttctcggattttcatatttattactccgtcaaactgaaagtttctttttcttgataaatggggattagttttccttttttccaatcagcaataaccacctatggtcaaagcatatttgtccctccttgatatagggattaaaacctgttttatctccaccattcaaatcgtattccattttatcaataatatctttttgaatatcctctggtgtacttgtcaaatccatccaactttgtagatttacaggaacaagtgttgtttcttcaagctgaagctcaaaagcatcctcaaacaatgcttcaaattcttctctgctaagtattcttgtatgtgagttatcacgcatcgtttcaatagcgtcattagtttcacgcaattcttctgtagtcgctaccatatcccaaataacaagttttccaccttttttcaaaactcgttgcatctcccgaaaaggcttttcaggctcaacaaaatggtgcaatgaaagtcttgtaatcacaaggtcaaatgtttcatcttcaaaaggtaagcattccgcattccccgatacaaatgatatgttctgaataccttcttgctttgccagtttttttccctgctccaacattgcttctgtcaaatccaaacaagtaatgtccttaacataaggagccactgctcttccacatatacaggttccagcagcaacctccaatgcatgttcattgccctttgcctgaatactacgaatcaaataatcggtatattctgccttagacatatgatatgaagcaaatttctctgcttgtgtaccaaatgattttttcacttcattatagttattcataaacttttacctcgctgtaaacttcaaagtttctgttccttacaaacttgaatttgacttgcctattttcttaaaatctcatgtggagcttctatttcatttgccaaggtatgctctgttaattctgacatcaatttcaattttttattaatcaatggtcgcatacaattaggaacatgttcctgatgcgctctgtggattgctacacattccttacagtttccgtgataacgacaggctttcaggcaaggacagtgatctttgtctttatactccttacgaaattccgctgcaaattcttcttgcagtctcagcccctcgacacggtttcccttatgaaattctaccattgcatccagttctttctggttcccttcaatcttcatgttattatagcgcctccatttcaactattcctcattttctgataaattagaattttcaaattagtctttgcaaataacctttgaaccttcaccatcaattacaattccctgacggttgttaatcgggcatagattcaaatccgaaaactcagtcattattttctcggtaactttcttaaatggtgctgtaagataatgcggaagaacatagaaatcaatcaaatcaagccctgcatcatcttcttgtgagtagtcctctggcttttcatccatttgctcgatatattggatgcttggagcgcatataattgcgcctgccgactcgccgatcatcaattttccatttgccaattcctttttcagtagcccatcagttcccgttttacggagctggtccataagaaagaaagaatttccgccggtaaaatatatcacatctgcttcttcaaaaacagactgtatcgttgaataagcctccgttgaaatatcaatttcagttacgattgctcccaactttttgaataattttcgagccgagccggcataaccggtgtagccttcacgcagtgaagctgttggaataaatgcgactttcttattttcaatttcttcctttatcagacttcccacacttgaaaagtgcgaacataaaaatagtttcatcaatattctcctttataaattccgatttgcacatcaaatcgttttcttcattctatcacaacttctattgatccgccatcagtctttcgaaccaggtatccatgacaatgataaactggcctgttcctggcaattcttgcagcatttcatcaagagttttctgtttcacatatttctgcacatacacccaacaggcaacgctactggcttctgatacaatgtcagctatggttttgcgcataagctcttcaaattcagcaatttcttcttttggaacaacatcatacagggttggtgcctgatccgttctctgtgaagattgaaatctaccatacttaaaatggaatacagaattctttttctgtatttcggtataaatactatgtgatactggcatttccatcgggtatgtgataaacttctattgtccatttggaccgcctcctttgattttgagtttggcttgcgacaccattctcatcatatcacaggaggctttattttgttgtcctcaccgtctccacttattccattctccccagcatagctgggggattagacttttcattaaggagaaggataccaagtgggcagtgggcaatacggtggattattcatcgtttacggtggttgtttgctcagttttttggaatatagatgattttgtcacaggcgtaaagttcttctcccccgctgtttcgcatttcatatccgatatatttacaattcccatccaactgactataataaagaatgtccgtttgcctgcaaaggcgcggaaccatatccatctgcatcagggcgatatgacagaaaaatgaacttaaaagaatggaagaaagaacaatggatgtaattgaaaaatttggaaatagggtgagcagccaggcgcttaaggatccagaaaaagcgcgtcggctgcttcttgcgggataccgcctgcaggaaaagaagcttcagtttttgccggatcgggggctaccgtcgtcgggacagtatgtggcgcgggtggttatgaaaaatatcattcagtcgctgtcggaaccggagaatgcggcgatggtcagcatatttgtgccgggagagctggtgatggcggcagggctgacgccgtactcagtggaggcgatgtcctgttttatggcgggaacaaagtgtgagcagacgtttcttcggaaaacggaggaagaaggatttccggagacgatgtgttcgtaccacagggtgtttctgggggcggcgctgacggggattctgccaaaaccgaactgcatgatttatacgaaccttgcgtgtgatggaaatatgatgacgtttccgtatttaaaggataaatttgaatgtccaggcttttatattgatgttccgtatgagaaaaaccgggaatcggttctgtatgtggcggatcagctacggaaattaaaacggtttctggaggagacgacggacagacggatttcggaggaaacagtgcggagtgcggtagataacagccgaaaagcggcagcgaattataaaaaacagcttgccctgcggtgtgcgcatgacccggtgacctctctgacgaatgaattgtatgcgctttttatgtgccatctgatggctggctcagagacggcggttacctatacggaaaaacttctgcgcgatgtgcggatgtcaccgaggggagatggtctttcggtaatctggatgcacatcatgccatttttacaggagccggttaaggatatttttaattatagtaagaaaatgcacatccgcgcttgtgatttcatcgcagatggttttcaggagatgcatgcggaagacccgtatgaggcgatggcagagaaaatggtctactgcatttacaatggcagtgtgaaacagagaattgaggaagcggaacggcttgccagaatcacggaatcggatggtgctgttttatttgcccactggggctgtaagggaacgatcggtgcatccagcctgattaagcagtccttagaaaagacaggccttccgacgatgattctcgacggtgacggctgcaaccccgccaataccagcgacggtcaggtatcgacgcggcttcaggcgtttgtggaaatgctggaaaagggcaaggaggagaaacacgcatgatttattacgtctgtaagtacaccccgatcgagctgttccgggggtttggagaagaatgttctgttttggaggaaatgccggaaaatttcgaacagtcggatcaaattgcacatgcaaatctgtgcggctttggaaaatcggtcattcaggcagtgctggaaggaaaggttgaacagctggtgctggtaaactgctgcgattcgatgcggcgcgtttacgatatcgtggagagcacgggaaaatgtaagtttttatatatgctggatctgccgcatgatgataatgaatgtgaaaaagtgaaatttgcgggcacgatccggaggcttaaaaaggcatatgaggcatattccgggaaagtgtttgataaacgcgcttttatcaagtcctttattacgccggaaatgaacacggagccgtacattggtgtgctgggcgtgcgggtcagcggcattctggaggatatgatccgggacaatatccagatggatgtggaaaatctgacctgtacgggtggtcggaaactgtcggtcgtacaggatgaaatgtggaatatggaggaagaggagctgtttctttcttacgcggacgtcctgctgggacagatgccgtgtttccgcatgaaccgttcgatccgcagaaaccgtctgtatctggatccgaatttaaagggaattatttatcacacgatcaagttctgtgattattatggatttgagtatgcgagtatcaagcgggatatcaaggttccgctccttaagattgagactgattttacgagccagagcgcggggcagcttttgacgcgcattcaggcatttgaggagacgatcgagggatcagaggatatggatccgggaaaaggtatcagtgaggaggcaagaaagaagatggagtcaggcattttttatgtagcgggaatcgacagcggttcgacaagtactgatgtggtcatactggatcaggatggaaaaattaaatcgacgatgattattccgaccggcggcggtgcgatgatgagcgccgagaagagtttggatctggcgattgagaaagcgggaattaagaaagaggagatcgtgcggatcaatacgaccggatatggacgatcctacattgacagcggggatgacagcatcacggagattacctgccatgccaagggcgcaaattatctgaatccgaatgtccgcactatcatcgacattggcgggcaggatatcaaggcgatcagcatcgacgggcagggagccgtgaaaaatttcctgatgaatgacaaatgtgccgccggaacgggacgttttctggaaatgatggcgaaaacgctgggactttccctggaggaaatgagtgtgaaagggctggaatggaagcataatgtcgtgatttccagcatgtgtacggtgtttgcagagtcggaggtcgtgtcgctggtggcacagaataaggatgtggcagatattatccacggtttaaatgtgtcagttgcctcaaaagtcggcgcgttggcagcccgccttggaaaggatcatccaggcgaatatatgatgaccggcggtgtggcgaagaaccggggtatcatccaggcattggaagagaagcttggtgctaaactttacatctgtgatgaggcgcagctctgcggtgcgctgggagcggcgctatttgcttatgagaaatgtaaaggcagtgcggaggaaacgcgatgaagcgacagggttaaaacacttgtatcgatattttcgtcagatattcactgggagaggctgtggccaattcgtcgatcacagcctctttataagagtatttgccggttttaaacttgtgttcatcggtccaatcaaagagtttttcgtaggtgactttcgagtcatagtaatttcccattaagtaagcaagtaccttgccagcccaaagtgctacaacagtcgccctcaacagcatatccaatatgcgcaaagaagaagtattgcaatatagaactacaaccttcctcttccatatttttttaatatctgacacatttttacggattgcattttttacacggatcataacctgcagcaatcagcgcatcactactctctgatgaggattttttattgctctccttcatctgtttgaccgatgaacaggacggccgatgaaatttctttgtattggtattgaggatataggattccgtgctggtctgctgagaagctacctgcgtaacagcctgtgtggcctgctctgttactgccttcaaaaaccggagtcacccgatacagcacatgatttccagtttcttttacatagtccgctgccatattctcaaacggcagcattccctgaacattcagatatctggtcccagtgattaagttcttctcgtttgcattttctgcagtaagctgataaccgatcaaatggcagcgattatataaatatttgccatccacattgtcatatttgatcgtatgccaaccagatggctttctctgacatttctttatcctcttttctttgaaatatgaaagaaaaattatcccttcatataacgaaacgctcagagcatgttttacagtggtcaaaagcaaatttttttactttttttcttacgagttttcttgcgtgttttttaaataccactcgtaagaaactcgtaacattagatttttcagtaaagaaaaagagcatatggaattgaatccatacactctatgattactgaaactttatttcatttttaattcaacaaacttttgtttatctcgttcttaacttcatctttattctcgtatgttctcactatcggaatcgtactctgtctgttctacataatctgcggaacagtctcgtttgtacggataaaaaattcaagtcgagcatccgcgagacttggcgcgtgattctgggcagcgtaagctgacatattctttacagaatcactgcgcatcctcgcggagcgtttatctcagtcgagaagactcccactgagacaaatttgctgttactcaccacctgaaagaggtgggagtcttctcgactgagataaactgagccacggctgttccaacatgaaatcagccgtggccttatttatatcatttcactcttttttgaaatagaacaacaccacagcaacaactcaaatcgttttaaaattccagactattcgcattcagcaagaaatacttcattcccatgatgacaaaaccttcatcatttctccaaggctttttgctgccatttacaatgacgatcttcttgaaagagtccgggatattacgcagagaattgaactcctgcgtctgtttttcttccgaagtcatgtcatatgcaacctggatatagtatctctggtttccttgattcaccacaaagtcaacctccaactgcttgcgaacacgtttgccctctttatccttatcgaagatatccacgacacccacatcaacattgtagccacggatcagcaactcgttataaacaatgttctccatgatatgagtaggctcctgctgtctgaaattcagacgtgcatttctcagtcccagatcagtaaagtagtatttcagatttgcaccgatatactttctgcccttaatatcgtatcggcttgccttggaaatcaaaaaggcatctgtcaaatggtcgatatgcttggagatggttttattagcataagtcatctggcgctcactggcaaatgtattggcaatctttgaagggttagtcggtgcgccgattgcagatgcaagcacatcaaccagaatcccaatctcatccacgttctgaatcttatttctttcaataacatccttcagatagacatttgcaaagatgttcttcagatagtccgctttctgtcgttcgctctggaaacttacgatctgcggcaatcctccgtagatcatgtagtcatcccaggcatcatcataatcgccgtcatagacagaataaaactctgcaaaggagagaggatagattctaatctcatcacctctgccacggaattcggtcacaatgtcgctggaaaggaacttggaattacttccggtgacatacacatcaatattgctcatgcggagcaggctgttcagcacttcctcaaatcgtggcatgaactgcacttcatccaaaaggagataatacttcccgtcgtctttcatggcatccttgatgtacttgaagcataccttgggatctcttaattcctcgttctcaataccatccaatgcaatttcaataatatgatcaacatcaacgccgttctccagtaagtatctcttaaagatggtaaacagcaaaaaggatttgccacatctacgaatgccggtaatcacctttatcattccattatcttttcgctcgatcagctgctgtaggtaagcgtctcttttaatctccatcgttacactccccatttccgtgcatttacacactttttagtaatgaaattctatcacagaacgacctgaatttcaatatgtattcccattttatgtgcatctacacacttttatgtaatgttgataaatatattttcagatttttttgattgcagtgtctataatcgattactccaatcgttattataggtaaacaacaaaaagaagatggttccgatgtttcattaaatatgttcgttagtcttttacgcaaaggattttatctcctctgcgccctaatgcttttcggattcagttcaacaaacttgaatttgacttgcctattttcttaaaatctcatgtggagcttctatttcatttgccaaggtatgctctgttaattctgacatcaatttcaattttttattaatcaatggtcgcatacaattaggaacatgttcctgatgcgctctgtggattgctacacattccttacagtttccgtgataacgacaggctttcaggcaaggacagtgatctttgtctttatactccttacgaaattccgctgcaaattcttcttgcagtctcagcccctcgacacggtttcccttatgaaattctaccattgcatccagttctttctggttcccttcaatcttcatgttattatagcgcctccatttcaactattcctcattttctgataaattcccatacaaactggaatttggtgtgtgctttataaattttttccgatccactcaagttcgttcatggaatccttatttttttcaagttcatctctggctgttgcgtaatatgattttttgaaaagcatatcccatgaaagatattttgccatacagtcaaactgcttatcaatcagctcatactggatactgtctacgggagaaccacctacaacaattgtgccaacttttttgttttttaactgcaatccacggcagtagcacttatcaatgataagtttcaattgtgctgacattccccaccaataaactggtgtagcaaaaagaatcatatctgcggcagcaattttatcaattgtagaatttgtatcatccttatcgacgcatcccttagagcattgacagacaccacatcccttgcatggtgcaatgttgagtttgtcgggttcaatgatttcaattttattcttttctgacgctccttttataaatgcattgattgctgccagcgtatttccttttctggcacttccattaatgattacaattttcatgcgtgtatcctccaacttccgatttgcacatcaaatcgttttcttcattctatcacaacttctattaatccgccatcagtctttcgaaccgggtatccatgacaatgataaactggcctgctcctggcaattcttgcagcatttcatcaagagttttctgtttcacatatttctgcacatacacccaacaggcaacgctactggcttctgatacaatgtcagctatagttttgcgcataagctcttcaaattcagcaatttcttcttttggaacaacatcatacagggttggtgcctgattcgttctctgtgaagattggaatctaccatacttaaaatggaatcatcttcacttaatactcggatgatcaccggtactttacggtatcctagtttctccgcagcatgttttcttctgtggccggatatgatctcatagtagccatccggtactggtctgacgatcagcggatttaatatgccatacttctcaataatttcctacagaagaaacatttccttatcatcttttacttgaaatggatgttccttaaaatggtggagacgttcaatctcaatttctatgattccttcttcgttttctcctgattgtctgtttggctcagtcatcttgactcctttcctccaggattcaggatactaaaaaatgcctgcctggaacttttatagatagtaaagttccaaacagacattgctgtttgaccattagctgcagctaatagaattaaatactgtttcagctaatttatgtttgcaggtttgggagagattgtttcttttcccgccttttctctgatttacatccccgaataaggggtgacaacagagcagaacccaaatgttagctgaacttcctaaagcccatgtttgcaaacaggtgattttgattagctgtcagctaacaaaaatcggattgcgttagctggaaattgatcattttgaatggaattttgtgtcacgaacgtgattagaaaataacaaaagcgttcgctgtcagctaatccagctaacattttcgaacgctttgaagcccgtcgccaagaggatttgaacctccgacccctcgcttaggagttcatcctggtacagaaaacagcttgcattctatgtcaatcaaagtcattcaaagccttgattttactgctttttctgtcaatttcagaaaagataagaaaacctgttttcatctgaggaattacagtttgggtggaaaaatggtggattttccaccattagggtaaagccaacctgttccttccaattataaatgatgactaccattacctgacattttacagtaatgattatttggttttcttattagatctatgtctattataccgtgcttgcggtcaactgtcgataacaaattgaccgcaaatgtattattttttcttacgtttacactttgtatcacaaaacttctacacttcaaatactcggaagtgtttctgagcagattcatatttccctgtttcgtaatttagtattttccataccggatttaattgctcgtccgttaacggagtaacctgattgtctttatccagccatgcaaaaattatctgttctgattctatccaggttaagtttttatccttctttatctcatcaatattctcctaaatatttttctagtcattgcaatataaaattgcttatacagtctctcccttaagagtcctggtattctggataatatacagagcgaccgatatgaccatcattatagcgcacaaaccaatcaacagatctgataccatcggtgtaatgtggaaccatataatatgcaccgctgcagttccatataataaaaaggttactatctttccatgccagtctgcaccatgtacttttcctgtcttttgtatcacaagacatccactgactatcatatacagctccttacctgccattattacgattaaaagaagcacatgcggaaaacgagtaaacagacagattaacatcgctgcctgtgtcagcttatcagccaccggatcaagtatttttcctaaattactaattctatggaatcttcttgcgatatatccatcagcaagatccgtaagaccagacagcaataagatttcaccagctaacagaggatttttctttacacaataactccatataattaccggaatcagacaaagccgaaaaaaagaaagaagattaggaaccgtaataattctattcaaattttcttcctgattcacttcactctgcatgtacggtcacctcactttccttttttttagacataaaccaataaaatataacacaaaatgctaaagcaaacacaacaccaaaaacattttgaatcactctaagactaaccgctccttgtagtccataagtctctgcagcaatggctaaagcaccaaatgtgttaaatactgcctgccagccatattgtgctgaaaatcctacaccgattccaccaagaattcctatatatgcatagattgacgaaggaagcagaaaatataatactgtaaaacatataacacctgcaatatttccgacaatccttttacggactctgtagtgcatatcttccataaacggcaaaatcgcggacatggccgcaataccagcccacattgcacgtggcatattacaaagttctgcaatgcaaaggacaatcggtacgcataaaatctgacatatctgccattttgttctggaagaagtgatatcaaattcttgtatcagatctttcagatttcttttataagttctgtttttatgatttcgataaaatacaaagcaggtaagtgctgcacctaaagccattccgactaatcgcatctgatagctttttcccgtaacatcataaccatatagcagcagatacccaagaaccaatgtagattgattaaacatgaatggattatggcatccgaacagaatcaacacagccagtgccgcaatatttaacagcattcccaatactggtgaaaactgatttgctaaatgcggacatacagtcataattacaaagaacaaagccaaaagcatcgtagattgtccggtgtggatccccagatccgcattccgaaataccataaggcataataaaactactacacccacaatactattctcatttccaaataagatactgaaaatagtaacaaataaaaaacaaaatgccattgtaacagctatctttaccaaatataccagtatatgatatgatttttctttcactgtttcactctttttcaacagatttttagaacctgcctgatttaactgcaattcctgataaaatgtcatgtaattcctcctctatctgtttttcttaaacttatatggcctcatctttctgtattggaagctctacaacaaatctgcatccaccatattcccggttttctgccttgattgtcccgccagcactatctacgatccgtttcacaagtgcaaggccgagaccatttccttctgctttgtgagaaccgtctgcctgataaaatttatcaaatattctggttttcacatcatcctctattcccggtccttcatcttccagaataaacattacagaatccttttcctgcttcagaaacatcataattgtcccctttgcaggactgaacttaatcgcattatctaaaagattcatccatatatgcataaaaagtccttcattcccagtatatttaacttcctccagctctacctggaaaccaatttctttttctgtccattttgtttccaatgaaagaaatgcctggcggatctgttcatccagacgatattctgtttttttcattggtatattctgattctctaacttggataacagcaaaatattaccaaccaatccggaaagtctttgggtgttaaataagattttttctacatattcctcttgatccggagacagttcttctccctgaagcagcattgtatatccttcaatggcattaatcggggtcttaaactcatgagaaacattagatacaaaatccatctgcagcacctctgttgcacgaagttcttttgtcataacgttaaaactttgataagattctccaacttctgctatacggctgttcgtttccaaatgctgttcaaaatctccctgagaaacttccttcattgctttactaagtctggtaattggttccagtaactttgcattgataaaggaagtgatcagccctgcaatcaatgtattgaaaatcaaaagccagccaagcacaggtatgccgcccggcagattaaaaaaatgattcaaaaaagcaaataataaagcagataggactgttgaaaatacaagtgccagccagattgcaccagtcagacaggatcggatccgcaatcctttttttttcttttgttccattatctttttaccaccttgtatccaattccacgcattgttacgatttcaaaatccgggttatctttaaaacgctctctgattcttcctatatgtacctctattgtatgtgggtctacctccgtctcgtatccccatacttcatccatcaactgttgttttgtaaatgttctgcctggcgaagctgcaagcttatataaaagcaggaattcttttttaggcaaaacaagactttccttatcagttgtaaccgtcattgcatcataatcaaactctgttgaaccgatcacaattttgtgttcattcagtatctgtgcacggcgaagcagtgctccgactcttaaaaccatttcattcacatttaccggttttaccatataatcgtcacttcccgaaagaaatccctggcgcatatcatcaaaggaacctttcgcagtgatcataagcactggtatctgatatcctgctgaacgaagttctgacaccagttcatagccatccataaccggcatcataatatcagaaatgatcagatcaatatattccttatccaatacttctaatgcctgtgctccatccgatgcatttttgacttgatatccattcttctcaagcactttttggaatagctggcttaattctttatcatcttctacaatcaatatttgaaacacgttttccttcctccttattaaaacagataccttgcccatccaagcagatgctgtaccaaaaatatttttctctgacgtttctttgttaattcaattggctctacatgatatggatcattataagttccgccttctaatatctggcgggacactttttcatattccatcatgccctcttccaactgtttattaatatctttactgcgaattacaagcatcagttccgtatccagatacgtgcttctcatatccatgttaaaggaaccgattacggatagatcatcatcaatcaggatgctttttccgtggtaagaatagccgccttcatactcccagatatcaattcctgtatttaaaattctgtttctgtttctcgcataatcagcagaaccaaacggatttccattgttggcaaccgaattggtcatgatagaaaaatccggaactctctccgcaatctctttccatgtattatacatcatatcattgcagataatatatggtgtatgaattttcacgcgctcttttgcatttttcattagttctcccagttgataccagactactggttccttgggatctgtgtgaataggatttgacactaatgtaatcttttctgtctcaaaagtttcgtccgtataatcggtctcgcagattctttccttattctcttcaaaatatttctgatagccgttctgcagctctaaaactgcgttctttacagattttctatttgccagttttttattgttatgaaaataaccactgtcttcctgattccatatggtttcaaaatactctgacaactgattaactgaattttccttctcaggttcatcgcaaaccactaacacgtctctgtcatagttcttatgtcccggaaaatcacccaggaaataattgtatgtatttcttcccccaagaatatatctctttccatctgcaatcaaatatttatcatgcattctacccatcattttccacggtttcaacggattggccttattatacagtttaatttcaacattctcatgggaagataatccatagaaatacggatttccttccatatcaatccagctctccattccatctactaacagacgaatatgtacacctctgtctgccgcatcatgcagtgctcctaaaatcaattttccactttcatcggattgaaatgcaaaagtagaaagaataatgtcttcttttgcatttcggatcaaacgcactctttgtaaaagtgcttctggatttttttctatgatcactgctcgttccatattctcactgcattcgttccatgacccattttttgtttcttttttggttgtattggacacttccggctgctttttatatgcaacgcagattccgagcaattcataaaaagccacacataaaaaaattgccagtataacaagaaggattttacatattttatgctttttcattgtacatcaccggattcctttttatttcatacttatacaatacaaagtcaatctcaatttaacctcaacaaggtttgtttttttcatccatgcaaaatcttctttgtacaacagactgttagatatagcaaaaacggcctttcaaaaacagttaacttctaaatcaactgttttttgaaaggtcgtttcatcagattcttatagcaatccagcaaataatctcataaataattgtcccagtcgcaaatatgcacttcgtccggtttgatattggtctgtcacatcacgacattcttccatcgttcttatcaaatcattttttatttccacaactgcctgacaatctgccataaaacagccgttttcaaaatggtgatataaacttcgataatccagattaattgttccacaagttgccatacagtcatctgccacactcatttttgcatgacagaaaccaggagtccactcataaacacgaacaccatgtttaactaatccatgataaaaagaacgagttatattataaatgaattttttatcagggataccaggtgtgataattcttacgtctacccctcgcttagcagccagacataacgcatgcgtcatttcatctgttatgattagatatggagtcataaaccaacaatatttttcagctttatttatcatactgatataaacttcttctcctacttgctcattatccatagggctgtctgcataaggttgaacaaacccagtttgctgtgccgcataatcatagtggaaaaggtatttactaaaatcagaatcattagcatccttatcacttactgcattccacatttccaagaatgtcaccgtaagcgactgaacagcatctccttctaaacgaatacctgtatctttccactgtccatacgggtgtgtgtaattaaaatattcgtttgctagattatatccacctgtaaatccgacttttccatcaataactgttatttttctatgatcacgattgttcaaaaacagatttaaacctggcataaacggattgaatacacggcaatgaattcctattgcctccatctttttcacaaaatctgtgttaataaagcctatagaacccatatcatcgtagaatactctaacttccacacctgcttttactcgctcttccagaacatcttgaatcttatgccatgcttcagcgtcttctatcgcatgatattccataaagataaacttctgtgctttctccaaatccttaagctgtgcctctaatcctttcactgcttcatcaaaatacacaatatccgtattctgatagattggatactgcgaatttctttgtatgtaacttgctatatttcctgctttcggaattgtttcttttattttgctcaaacacgcctgactgtctggaagcattggtaacaatttgctatcaatttctgcatatctctcacgcattttatgtgtgccaccattcaaaccaatcaacaaatacaggcctacacccataattgggaagattagaattaagatgacccaaggcattttcatagaagaggtcttatctgatgcgtacaatcccaaaaccaagattccactcaaaatccttgtaaataaatttataatttctgcatattcattcaagcgtgttacgatagtaataataaaaattacttccagaagaatgcagactatggaaaaacacagccgttttaccccattttttgtttttgctttgccctctaaagtatcttgcttcatatatattccaccttcctacttgctcagttttctgcctaaatttcatgaaacataccaattttgtcttttattctctgcatttcatcatccgcttcaatgatagctcttgcagaatgaagtaattcttcacttatctcatcataaccaggcatttcttcaattccttttttatagcgaagttgatgttccaatgttgcccagaaatccataccattggttcggatctgtaattctacacgcataggtgttttacccttagcaaaaaatactggtatttcaacaatcatatgatagcttcgataaccatttggttttggattttttatataatcttttatttcaataactttaatatcatcctgttgggtaatcaaatctgatatcatataaatatcgtcaataaacgcacaaactattcgaacgcctgctacatcatttaaatatgtctgtatattttctgttgtaaaatcatgtcccattttctgcaatttattgtaaatactattgggcttcttaatccttgtttttataaaagaaataggatttcgattgttctcaactgaaaattcatcatccaaaacctcaagtttagtttgtatctcccgaatagcacaacgatacatcatcattaaattataaaattttgtagcattatttaaaaactgtagtgattccggactgttcatcctgagtttttttacttcatcttttgtcatggaactttcctttctacctcatccctgatttcaaaacattatttattttgatagttgattcgttctccttgaattactggataacaaatcattttatcactatccagattttctacatgcatatctactgcactgatctgatggttttcataagtattgtaataataaataccttttgtaacattacaacacgacgtatacaatgtgatttcatattttccatccgttacttcgcaacatcctcgttgctgatccacagatccgagaatgtggaagaattggctaacgctttcttcctctgattcacctgaaattgcatttacctttgtaaaagctacacgtacaaagcgtgaggaagatgagagatctcccggaagacctaatcctcccatacctctactatatgcatcaagagccaaattttcgcagaaagtatttctgggctgtttaggagataaatacatataattatttagttgaaacatctgctgtggaaatggcggattattcgtaagcactcctactggattgtcataaatatgcaaaccatctgacatagattctaccgtaattgactcattctcatcagaaatgatccagtgtaattgtgctaatggcaattgctcgctgaaaggagtattaacaatattaattcgttcaagaagctcgcgaacttcaactaaagaagaacactgacttaaaatccacggaataaattcaaactgtgcaatattttccacatctggcttaatcgttgcataaacagcatttcctacaaaattcagtcctgccattgccactcctttttcattcatagcatcataatacaaaggataatcctctgcaacatgagccattccaataattgcataatgatttttcatatcgccaacatggcgaaaattaaacgcataattacgtggtgtaattactatctgatcaccataagagaattcataatcgagggttcgtccaaagtaaaaatcttttgttttataagttgctgctgtacacatgatcgtttatcctcctaaacagattgaaatatgtcaatgagttttttcttgaacaatagtatagcacaatcttttattttgttccaacttcatacatgatcataacatgtaaactttaaactattttcctagattatttctccatcagtttttcaaaccaggtatccatagctaggatgaattgacctacgtctggcaattcttgcagcatttcgtttagggttttgtgcttcacatatttctgcacatacacccaacaggcaacgctactggcttctgatacaatgtcagctatggttttgcgcataagctcttcaaattcagcaatttcttcttttgggacaacatcatacagtgttggtgcctgatgacttatttttactccattttcatttgcatctttaagcagattcttaactttttctcttgaatcctccggtactttcatgtactcccacataaatgctaccacatcggctggtgtgtcttttttaagtggcggtagctgaatataatcattgtttttgctcattttcatattctcctcacgatataataaaatcaataatacgttctcttgtcatgtccaggacagtatccacaagcactcctgcaaacaggatcagatacagaattgcactcagcacaaacaggaatgcaacctgtacccagtcatggtaacagtatgcagtcgctataatcaacaaagtgaatgtaaacccaaggattcctctgacaaccgcataagtctgtactgtcatcttcactgccaggccaatcacaaaaaggatcagccataccggcagtaataatatcttcccagcaagttttaaaataaacatgtgcacctcctatcttaccagtcctggcatatcatggttcacctctgcctgataatacccgttcatcgttgacggtgcattaaacaaagctgctaataaatatttcttgatgttcttcacctttgtggtgttaccactcatacagtgtaagacatactcgatatgtgaataggtcagcatcagaaattttttcttcaccagtgatgccggataccagttgctggcaatcaagatcttgtcatttttacacatcacagtttctacgatcaggttcacgatttcatcaacctgtcgcatatcgtcatgatgggttacttccagtgactcataatcaacggtctctttgacaaggttttcataagcctgataatcctcagaacgattatcgctatcaaatcttttctcatccacagatatgatatgattagatttattatcattcatttcagtatcactaagattagtattattagggtttgaaatgtaaacttcttgaagtttgttttcgggacttcatgaagtttgaattgtaaacttctgcgggttcctcattttccacagaagtttgttttttaaacttctttaattcctcttcaaattttttctcatctgttttctcaggcataaaggttttcacgtagatgacgttcacctttccaaatccctgtctgcgtttctcaatcaggccaatccctgtttcgtcatccagttctctcatggatttgatggctttatttctgccacagttcagtaattccatgatatcttcgatggaaaagtagatatatgctctgtttttgtcgtcaaaccactgattcttgatggaaagagacattcgatccaacatcagtccatataaaattttagcatcgcttgataagtctttaaagtaactgtctgtaaataatgcttttggtatgcggtagaagctgaactgatcagcttcggtaccgtaaaaataattaaatgtcatttttttctccataactgcctcctttcgttttctgctaagaagtcctctttttaaacttctttgactttgttttcttaactttttctatccttaacaggactgttcatgcatccatttttctaataatgattcaatcacctgctccatatctttgtctgtataatcatccggaaagtactttgtcagtttcttttctgagaaagtgagagaccgggatactttctttgccatcacacagttattgaaaattgataacatctgaatctgattgattggcccatcattcagttgatttctaagtgttgcaatctgtttgggcttgataaatccagtgtcgctgatatattcgtaaatccattcctgtacttccttatcgatataggagatatcaacagcaaccgtgaactgaagctttttgttatctaccagatcaagcagttccggaattaactctgtcaggcggataaatctttttacctgatgaccacttattccctccgtttcaccaattatatctgtggttaaattcgggacaatttgtcccgtatttcctttactgggtctaccagcttttcttttcattgcctcaagtttcatcttataagcaaaggctttctcactcggcaacaattcctctcgctgaatgttagcgtccaccatagccacaatggcatcatcatctgataattctcttacgattgccggaattgtcgtcagtcctgcaagctgtgctgcatgcattcttctgtgaccggataccatttcatattcttcattttcatccatgcgaagcagtaccggtgtcagcacaccattgatctttacactttcaaccaggtcctgcatcttttcatcatccagcaccttgaagggatgatttttaaacggatggatcttactgatctctatctccattgctgactcttcatttaccacaccaagcagttcatcaatacttgccagtttaatcttttcgccacttctatttttcattcttcaaaacctcctgtgttaagttcatatatgcttctgcaacctttcctttcgggcagtgcatgtagatgctttttccctctgcactggtctcagcagcttttacagacatcggaattacattttcaaatacctcgatctgacttccgtaggttgtatgtactcttgatgcaatgtcccttgcgtaattggttctgaagtcaaccatagtcaacagaatgccttcaatcgccagtttccggttcagtcttttctttactgtaagaatggtcttgatcagctgctgaagtcctttcaccggcagatatgcggcttgcacaggtatcagcacggaatcggaagagaccagtgcattgattgtcatcataccaaggctcggcatacagtcaatcaggatataatcgtatcggcatcttatcgcatcgatatattctttcatgatcatttctctgctcataacatttcccatcgttacttccagtgcggaaagctcaatatttgccgggagaagatctacattttcctggtgatgtaagatcccatcttccaaagagatttcttcttcgttgatgacatccatcatgatcgttgccagtgtgatgcgaagatcatccggttcctcatatccaagacttgcggttaaacttccctgtggatccgcgtcgatcagcaacactttcttaccttctcttgccagtccaatgcctacatttacggttgtggtggtctttccgacgccacctttctggtttactacggatataactttacacatgattgcttcctcctttaactttcccatgattcttttttccataattttagtagtgtcaatatttcccgtttcatcattgccggtgtataggaattcggaaaatacttatgtagctgttcgtttgtgaaagccactcttgtgatttcaccctttttaacctcacacatgatttcttccatcttttccagtgacaactgcttttctttactcagttgccggatcctctgggcctgtgagagtgacgggattgcctgtgcatactccattgctacaagcagttccttttgctctttttcacttaatgcagctatctctacagccggacaaaaagaaataatctcatcatccagtttctgcagcatttccggtatcagttttgtcagtgagatataacgctgcacttgttttgggctatcaccacaatcctcgctgataatctctatcgcccgctttcttggtgttttgtggtcaacttggctcttttttcgaccactttttctttttaatacgtcattcttcaatttgtaagcaaaagctttttcactgtagctgatccgttctctgtgaagattagaatctaccatgcttaaaatggaatcatcttcacttaatacccggataatcaccggcacttttcggtatcccagtttctccgcagcatgttttcttctgtggccggatatgatctcatagtagccatccggtactggtctgacgatcagcggatttaaaatgccatacttctcaatgctttcctgcagaagaaacatttccttatcatctttcacttgaaacggatgctctttgaatggacgaagacgctcaatctcaatttctatgattctttcttcgctttctcctgattgtctgtttggctcagtcatcttgactcctttcctccaggattcaggaaataaaaaatgcctgcctggaacttttatagatagtaaagttccaaacagacattgctgtttgaccattagctgtagctaatagaattgaatactgtttcagctaattcatgtttgcaggtttgggagagattgtttcttttcccgccttttctctgatttacatccccgaataaggggtgacaacggagcggaacccaaatgttagctggacttcttaaaacccatgtttgcaaaccggtaattttgattagctgtcagctaacaaaaatcggattgcgttagctggaaattgatcattttgaatggaattttgtgtcacgaacgtgatttgaaaataacaaaagcgttcgttgtcagctaatccagctaacattttcgaacgctttgaagcccgtcgccaagaggatttgaacctccgacccctcgcttaggaggcgagtgctctatccagctgagctatgacgacacatgccgcaaacccttgattttactgggtttctgggatttttcccttcggccatatataagattatcaactcttttttgagctgtcaatctacagattttttttgctaatgaagcataataattgacacatataaatgattttatactaaccaattcaaaaagtcaaccctggcatggctttttgaacgcagataagcaagtagcaaagcggattgcgaatgtccgctttaccgctttacccttgtcagaacaatggggataaaataaaaaggacatcctatctattgaattttttattttaagatagaacgtcctttttaagttttgctaaaggaagcttttgattaattatttacctgtattatttgctttttttcttcagcagttttgttcctgttaaagttgtgcatgagacagctaagagtgcaatccaaatcataacgtttgtatcatctcctgtttttggagaagtagtggcagaagtacttgttccggttgtggaagttttgcctgtagaggctgttgtttttccattggttgaagtatttgttgtactgcctgttgttttggtggtaccgttcgttttgtctgtagtgctgttatttgcattgttgctgttgtttttattatcgttaccgttattggtattatcgttcttgttgtcgttatcgccgttgttgatattatcgttcttgttgtcgtcatcaccatcatttttattgtcgtcatttttattgtcatcattctttttgtctgtaatagtgaaaacaatttcggcagaggaaccagcgtagttgccgatacctgtaacagttaacctgtagcttccagcgttgataaattctgtatcagcaaaattttttgcttcagaatcatctccgtagatgcaggaaacagtgtaatcaacaccttctgttaaaacagtttttccatcttttacagtcagagtcggtgttttagctgttccatcataagaagcagaatcggaatctaaagcaacatcaaaagtaagttcttttggcgtaatcgtaaatgttttttctacggttccgtagtaatttccaataccggtaactactacagtgtaagtgtctgtgtttgtaaatttaccatcggattctgttccatcttcgtttttgtaagtaatgaaataatccgttccttctgttaaaacagtttctccatcctgtaccattacagaaggggtaagttcttcaccggtataagtctgattttcaatgtctgctacagtgaaggtatttgttacagcatttgttatgaacttatctaatggaggtgtagtttcaacacctgtagtccagtataattcttcaagtgggtcattattgacatcattaccaatctgtgtaccattttcaatatgacggcttgcacttgtaacttttacatttccggaaatggcatttcccggtgttgcgtttttggaagtacgagaggtagctccctgaaggaaagcttcggaagttgtaatcattccgtttccaatgactgcatttccgccgttgccccagagtacgtcgccaccgatagcaataacttttccatttcctgtgatgttaccgttgtctaattcaatagcagaaccgccttctgcatagagaagtacgtttccaccaccaccataagtaacgagtacggcattatcttcaagatttacagttccgtcttttacgagaagggcagtctgtccaaggtcacttcctgcttcatccccggcaataaatacctgtccttttacagttacatttccatttgctacaacaactgcttcagaactgctgcggtctgttaagtcgccgtttgcaagatagttaatgtgagagtaaatagatgcattttcaaggatagcaccatcctgcaggcgaagctgtccacaaagagaagcgcctgtagtaaattcttgattgtaagaatcatagttcatagagaatgtaccgccgttctgtacgtcgatgattccctgaacaacagaatcggaaagagtcagcttaccgccggattctactacgatgcggacactgctgaggatttccatatttgtcatagtcagattgcatccagccggaatgtaaagggtctgtggaatgtctccggcttttacctgtttccatggaaggtcgtatccaagataaccataagtaccactttgatgggaaccaaaccatgcttctaaatcttttggaacacgaacgctgttttcttcgccttctacattgcttccgaagtttttgattgcccatggttccatgatatcccatgcataaagaccatttccatactgttttaaattgtcggtagtcagacggtctgctaaagtttcttcgcctgtgtaaacattaaatggtaaggagttgctgacagcggttcttccctgggtatctgttatagatacggaaataagataagcaccggcatcttttggagtaccgtttaatgtcaagtcactgctgatggtcatgtaaactccgctcatgccactgtcgctgtcggtaggagttcctttttctgtattcggaacaatgctgacactgcatttgcttccgtttaggttgatttttgaagaatggtcaagttcttcccagtctgcgtctgttggttcagtcccttttgctgtgatggcaccgtaaacttttgcagaactgtttttgctgctggtagcgccaccaacacttgcgcttgatacgctgtcatagttctgctgaccaatgatggctgattcaaaagagccttccagttttacgtgaagttcataagggtcgccctgtccgtcatcagcaactaaagaggcatttccatttgtatcaattacaaatttgaaagtcagttcctgatatccatcagcagtaagtgtgataacatcaccgctttttaaaacagggatttcaggatttgtactgaaatcttttgcggagaaaaccaaaacattattatcggtatctttatagtatttaccaccggcagatggtttaaaagaagagttttcccaggattctccatttacttttacgtcggtaacggatgtagcatagttatctgcattttggaaagaaagattccagtttgttccgaagaaatcagttgcaatgcttaactggttcagttcgatttttaccggttcagcaggttttatttttttaaaagaagctgatacagttacatcttcttccggcatgataaaagtataaacaccgtctgtattctgaagggcaacttcagttccggttgttatacctgtaactttaatggtatcaagttcatagttttcagctggtgcaggtgttacggtaacagtagtgccttttttgatttcttttgttgcgctaagctgtacatttccgttttcggtttcggctgcagtagcagaataggttttttcagcaggtgctacaacagttgcagtataaacataaggataagaagaagtattttttgttacctgaaggtttaaatcctgatatccgtccgcagaaattttaatagctgcaggataagtagaaggatttacgattttcagggctgtgtagcttccgtaagcaccggtcacacttccgacttcccagaggtttccgtttgacccccagctgttaatggttccctttgtataagtcgtatcatttacaacgacattattaattgcattcatccagcccatatcttcaaagccaagcgttaagatttcggtcataaatccggtgacagagcattcggtcactgcggttggtgctgctttatctcctgccgctaaaacaggtgagtatgtcgtagacagacaaatcagtaaagataagagcagggacgcaatttttttccatatttttttcatatctctctccttgtaaatatttgatttttctaatgttagaatggctgctaatacgattaaagatagtccccctttcactataataattagcacatctgataaaacaaaagttagtatattctaacaatggtaatacaatgctaccaacaattaccaatggtgtcaatgaaaaaaaacttattgaaaaaaattatctgtaagacacaaaaatgcgatagaaagtatacggaaatcttttatcaaacctataaaaatggtataatgtacccaataaatcaaggaggtgattgaattgaagaaagtagttttaatccccgattcatttaaaggaacattatcttctgcgcagatttgtgacattatggagcagaatgtgaagaaacactttccggagtgtgaggttgttaaaattccggttgctgatggaggagagggcagtgtaaactgttttctgactgctgcaggtggagaaaagagaaaggttatcgttaagaatccttacatggaggatatggaagcattttatgggattttgccggataagacagcggtgattgagatggcagcatgtgcaggacttccgcttgtggagaatcgtcaaaatccagaagtgacaacgacgtatggtgtcggtcagctgatgcttgatgctgtggagcatggttgtaagaagatagtagttgggcttggcggttcgtgtacaaatgatgctggtgcaggagcggcggcggcagttggagttgaattttttgataaagatggagagaaattgattccgacaggcggaacacttggaaaagttgcaaaaatttcgatggaaaatatggatgagcgaattaagagcgcgcagattatcacgatgtgcgatattgataatccaatgtatggaaaatcgggggcagcttatattttcggaccgcaaaaaggtgcggatgatgaaatggtgcagcagctggatgcaaacttaagaaaatttgcagagcggatacagacagaaatcggaaaagatatttcgaatatccatggaggcggagcagcaggtgcaatgggagccggtatggttgctttctttgattcaaagcttcagatgggaattgaaaccgtacttgatattgtaaaatttgatgaattaatccagggtgcagatttgattttcaccggtgaaggaaaaatggacagccagagccttcgtggaaaagtggtaattggagtcggaaaacgggctaagagacaagacgttccggttgtggttgtgacaggagatgcagaagaagtagaagatgcttatgatatggggatttcggcagtcttttcaacgaatcgggtagcaagagatttttcagtaatccgatataagagtaaagaatatatggaagtcacaatggataacattatgaggctgattaaaattgtgaataaatagggagaaattagaaaaaataaaaagagcggagacttggattttaggtgagtccccgctcttttaaatttaagaggtttttgtatatggattagaggtaagttttttatttaaccaaatcaagcaagtagcgaagcggattgcgaatatccacttgactttaatgtgtatagttattaagtagaaaaatttataagttcgagtaacccatcagggaagcgtccactgcctcagcagcttttcgtccttcacggattgcccatacgaccagagactgtcctctgtgcatatctcctgcggtaaatacgccaggaacagaagtttcatactggtcagattttgttgcaacattggttcgtggagttaagtccactttaaatgcatcggttacgtatttctggcttccaaggaaaccggctgcgattaatacaagctgagcttctatgatggtttcactgccttcgaccggaaccatattcatacgtcctgttttttcatcttttttcggttcaagctttacaagttttgctttttgtacgttacctttgtcgtctttgataaattcggttactgtggtctgatagatacgtgggtcatgtccaaagactgcgatagcttcttcctggccgtaatctgtcttgcagatacgaggccattccggccatggattcatttctgttctttcatctggtgcttttggcatcatctcaagctgtgtgacagattttgcaccaagacgaattgcagttccgacacagtcatttccggtatcaccgccaccgattacaacgacgtgttttccttttgcagaaacaaagtttttatctttgaaattggaatctaaaaggctctttgtaatagaagagaggtagtcaactgcaaagaaaatattgttggcttcacgtcccggaactttaatatctcttggattagaagcgccacagcataaaacaatgcggtcaaaatctttttggagttcttttgcagtgatatcttttccgacatctacacctgtcttaaagacaactccttcttcttccatgattttgatacgtctgtcaatcacagatttatcaagcttcatgttcgggattccatagcggagcaaaccgccgattctgtcttttctttcaaaaacagtaacctgatgtccgcgacggtttaactgcatggcagttgcaagaccggacggaccgcttcctacaacggcaacttttttgccggtacgaacttttggaatccttggagtcacccatccgtttgcataagcagtttcaataatggcacgttcattttcctttgtggaaaccggttgggaatccagattacagatgcaggctgcctcacaaagggcagggcatactctgcaggtaaattcagggaaacaatgggttttggttaaacgggtataagcttgttcccagtttccgtgataaactaaatcatttaattccggaactaaattgtgaagcggacatccggaagccattccggcaatcattgtaccggcctggcagaacggaacgccacattccatgcagcgtgcgccctgtttctgttgttcctctttttttaaaggggtacgaaattcgttaaagtgtttaattcggtcttttggtgcttcgacttttgctgtctctcttttatattctaaaaatcctgttggttttcccatgattattctgctcctttctgaaagttttcattgaaggcttctaactgtgcttcttctggtgacatgcccatttcttccagtctggtagccatagtaatcatctttttgtagtcatccggaataatctttttgaatttcggcagatattcctggaagtggtcgagtacttcctgacctttttcagaaccggtagcagcaacatgagctgcaatcatgttatgaagttcctgaatatcagattttaattctactttttcaatagaaatcatagatttattcaggtttttatacaattcatttttatcatcaagtacataagcgacaccaccgctcataccagctgcaaagttcttgccggttttgccaaggacaaccacacgtccacctgtcatgtattcacatccatgttcgccgacaccttcaacaactgcgtaagcaccggagttacgaactgcaaaacgttcaccggctacaccacagatataagcagtaccgcttgttgcaccatagagagcaacgttaccggtaataatgttttcatctgctttataatttcttttcttcggaggataaagtacaatcttaccaccggagagacctttacccatgtaatcgttgcagtcaccgcagagagttaaagtgagtccttttggaacgaaggctgcgaaactttgtccgccggctccattacagttgatggtgatggtatcatctggcagtccgtctttatgatgtcttgtaatttctgcgccaaggatggtagcaaatgcacggtctgtattggtaacttctacatcgatagaggctttttcgcctttttcgatggatttctgaagttttttcagaagaattttttcatcttttgtctcttccagtttgaagtcataaacctgagccgggtcgaaggttactttctgtccttctttggcgaatggattatttaagattgcacttaaatcaatcttagatgccatcgggctttccggatgttcttttacttttaagaggtctgttcttccgaccatctcatcgagtgtacggattccaagttttgccatgtattcacgcagttcctcggcaataaagcgcatgaagtttacaacatattccggttttccacggaaacgttttctaagttccggattctgagtagcaacaccaaccggacaggtatctaagttgcagactctcatcataacgcatcccattgttacaagcggagcagtagcaaaaccaaattcttctgcaccaagtaaagctgcgattgcaacgtcacgtccactcattaatttaccatcggtctcaatcatgacacggttacgaagtccgttcataagcagagtctgatgagtttcagcaagaccgagttcccatggaagtccggcattgtggatagaactctgcggagcagcacctgtaccaccgtcataaccggaaatcaggataacctgtgcaccggcttttgcaacaccggctgcgacggtaccgacaccggcttcagaaaccagttttacggaaatacgggcatttttatttgcatttttcaggtcgtagattaactctgccaaatcttcgatggagtagatgtcgtggtgcggtggcggagaaatcaggctgacacctggagtggaatgtctggtttttgcaatccaaggataaactttcttagcaggtaagtgtccgccttcaccaggttttgctccctgtgccattttaatctgaatttcttttgcactgactaagtaacggctggtaacaccgaaacgtccggatgcaacctgtttgattgcagaacaacggtctactttgcttccggcactgtcaagacgctcatcactttctccaccttcaccggtatttgattttccgtgaagcatgttcattgcgattgcaagtgtttcatgagcttcctgagaaatagaaccgtaagacattgcaccggttttaaagtgttttacgatttcatctacactttctacttcctcaatcgggataggattttcagcaaaattgaaatccatcaaacttctcagataaccactctgttctttatcaaccatgctggtgtactgtttgaataggttataatctccacgtttggttgcctgctgtaatgcatgaatggtctgtggattgtaacgatgtttttcaccttcactttttgctttgtgcataccaagactgtcgagctgaagatttgtggtaagtccaagtgggtcaaatgctttggagtgacgggcatcaacatctttttcaatatcttttaaggtaataccaccgacacggcttacagtaccggtgaaatatttttcaatgacatcggcggaaataccgattgcttcaaaaatcttagaaccctgataggactggatagtagaaatacccattttagaagcaatttttacgataccgtgaaggattgcggaattgtaatcatttacggcagcgtagtaatctttatttaataagttattgtcgattaattcctggattgtatcctgtgcaaggtaagggtttacggcacatgcaccataaccaagcagggtggcaaagtggtggacttctcttggttcaccggattcaagaatgatggcaagagaggttcttttctttgtttttacaaggtactgatgaactgcggatacagctaacagagatggaatcggcatgtggttttcatcgaccccgcggtcagagagcactaagatgtttgctccatctttataagctttgtcaacttctacaaaaagacggtcaattgcacggtcaagcggtgcactcttataataggtaatcggaacaacagccactttaaatccttttacattcatgtgtttgattttcagcatatctgtgttggtcaaaatcgggttgttgacttttaatacctggcagttttcaggctgttcgtgaagcaggtttccatcttttcctacataaacggttgtgctggttacaatttcttcacggattgcatcgataggcgggttggtaacctgtgcaaaaagctgtttaaaatagttaaataatggctgatgtttttctgaaagaacggcaagtggagtatctgtacccattgcagcgattccttctgaaccatttaatgccatgttataaatggactgacggtattcttcgtaagtgtagccaaatgcctgctgcatttttgtcagttccgtaccttcataatcctcaacacgcacgtttggaatttttaagctctttaattcgaccagattgctgtctagccattcaccataaggctgtttggttgcatatctttcttttaaggtatcatcatctacaatttccccttttacagtatcaactaaaaggatttttcctggatgcagacgttcttttaatacgatgtcctcttcaggaaccggcataacgccaacttctgaagaaaggataacgtcaccgctctttgtgatatagtaacgggatggacgaagaccatttctgtcaagtacagctcccataacatcaccgtcagagaacaggatggaagcaggaccgtcccaaggctccatcatagttgcgtagtactgatagaaatcacgtttttcctgagttaaggtctgattgtttgcccatggttcaggaatacagatcataacggcaagtggtaaatccataccattcataactaaaaattcaagagtgttgtcaagcattgcggagtcagaacctctggtatcaacaaccggaagtactttatgaagctgtccttttagatagtcagaagccatggtttcttcacgggcgagcatcttatcggcatttccacggatggtgttgatttcaccgttatgtaccataaaacggttcggatgagcacgttcccagcttgggtttgtgttggtactgaaacgggagtgaaccattgcgatagcggattcataatctgcatcctgtaaatctttaaagaatgtacgaagctgtccaacaaggaacatacctttgtaaacgatggtacggcttgacatggaagcaacgtaagtgttgtcattactctgttcaaatacacggcgtgcgatgtagaggcgtctgtcaaatggaagtcctttttcgacatcatcaggtttctggataaatgcctgaacgatatgtggcattttttcgagtgctttgtgtccaagtacttccggacataccggaacatcacggaatcctaaaaattccagaccttctttttctacgatgatttcaaacatctttttcgcctgattgcattttaattcatcctgtggcaggaagagaacggcaataccgtattctctttcgccaccgattttgataccctcttttttgcaggctttggaaaagaatttatgtgaaatctgaagcaggataccaacaccatcaccggtttttccttctgcatctttaccggctctgtgctctaagctctctacgatttttaatgcattttcaacagttttgtggcttttgatacctttgctgtttacaactgcaccgataccgcagttatcatgttcaaattgctgtcgatataaaccttgttctctcataatgattgacctctttcctttttatatgtggcagccgcctgcaccagtcctttaaatagcggatgtgcatgattcggtcttgattttaattctggatgaccctgagtaccgacgaagaatggatgctcggtaatttcaatcatctctacaattcgtccgtccggagaaagtccgacaagactcattccattttcttcaagctgtttacgatagtcattatttacttcatagcggtgtctgtgacgctcggcgatatcctgttttccatataattcgtaggattttgttccttcttttaatttacaaggataagaaccaagtcttaaggttccgcctaagtcttcgattccgtcctgttccggcataagagcaatgactggatgaagggtgtccggatttaattcaatgctgtttgcatcgtgatatccgaggacatttcttgcaaattcaataattgcaacttgcataccaagacagataccgaggaatggaattttgtgttctcttgcatactgaacggcaagaatttttccttcggttcctctggttccaaaacctccgggaacaaggattccgtcgagtccttttaaagattcctcataattttctatggtaagatgttcggaatcaatccagtggatgtggacattggcatgatttgcgataccgccgtgttttaaggcttccactacacttaagtaagcgtcatgaagctgaatgtattttccgacaattgcaatgtctacttctgtctgaggatgtcttaaatcgtttaccattgatttccagtcatccaaatccggttgtggacaaggaagttttagtgattcgcatacaacctgtgccagattttctttttccatggcaagaggtgcttcatataaatattctacatcaagattctgtaatacgtggctttgcggtacgttacagaataaagcgattttatctttaatatcctgaccaattggatgttcggaacggcagactaaaatgtccggctgaagtcccattccctgaagttcttttacacttgcctgtgtcggttttgtttttaattctccggatgcctttaaataaggaatcagagtaacatgaattaagatagcattttcatgtccgacatcatgctgaaattgtctgattgcttctaagaatggctgactttcgatatcacctaccgtaccgccaacttcgataatagcgattcgctcttcatcaggaaattttgcacggtagaaacggcttttaatttcatttgtaatatgagggataacctgaacagtccctccgccgtaatccccatgtcgttctttttgaagaacggaccagtaaattttaccggttgtaacattggaatttttatcaaggctttcatcaataaagcgttcataatgtccaaggtcaaggtcagtttctgtaccgtcgtctgtgacgaatacttcaccatgctggatgggattcattgtacctggatctacattaatgtaagggtcaaacttctgcatggtgacctgatagcctctggcttttaataagcgtcccaaagatgcggcggtgattccttttccgagaccggaaacaacaccacctgtaacaaatacatattttactgccatcacattttcctcctgctgttgtttcattatcagaaacaggttatgcggtcctgagtctgataaataagataatttcatgggattgccgtgaaatcaaaaaaaaggcgtcgaaactcccatagaaaatactatggaaattcgacgcctttgtcgttttctattcattatgtaagttatcagtcgttttcgggaagttcttggaactccgaaaattatgcaaatactatagctcatttttttttatttgtaaatcccttttttgaattttttttttgaaaaaatttttttaaaaaaagtgattgacaaatttctttttccgtgcaatactacatggcataaagcaaaggcgctttgaactacaaaagttcagagtgccttttttgtttttaccagagtcaaaaattgaaaaccaaaccaatccgtaggtaaaaacaaatttgagtaataattttaaaagcaaaaacaatcacatgaagaaaaatggaaaggagtgctgtgaatatgtcaaaagatattcctacactgtatggaagccttgttttcagtgacaaggtaatgcgtaacaaattaccgaaggatgtttacaaagctcttcgcaaaacaattgaaaatggaactcatctggaactggatgttgcaaattccgtagctgttgccatgaaagagtgggcagtagaaaacggagcaacacatttcactcattggttccagccaatgacaggatttactgctgaaaaacatgacagctttattactccggttggagaaggcgaagttatcatggaattttcaggaaaagaactggtaaaaggtgagcctgatgcttccagctttccatccggtggtttaagagctacatttgaagcaaggggttatacaaactgggatccaacatcaccggctttcattaaagataataccttatacattccgacagcattttgttcctggagtggagaggcgctggataagaaaactccgcttcttcgttctatggaagcgttaaacaaagaagctgttaagattttaaatttattaggaaatacagaagtaacaagtgttacaacaacagtgggtccggaacaggaatatttcttaattccaaaagaattatatgcaaaacgccgtgacctgatttttaccggaagaactttattcggagcttccgcaccaaaaggacaggaaatggaagaccattactttggtgcattaaaaccaagagttgcagcctacatgcatgatttggatgaagagttatggaagcttggtattccggcaaaaacaaaacataatgaagttgctccggcacagcatgaactggcaccggtatttgataccacaaacgtagcggttgaccacaatcagctgacaatggaaattatgaagaaagttgcagaaaaacatgaccttgtctgcctgcttcatgaaaaaccatttgatggaatcaacggaagtggaaaacataacaactggtctgtttctactaatacaggagtaaacttattagacccgggaaaaacaccggcagaaaatattcagttcttagtgttcttagtagcagttatcaaagcggtcgatgaatatgctgatttaatgcgtgtttctgcttcaggagccggaaatgaccatcgtcttggtgcaaatgaagcaccgccggcaattgtttctatctttatcggagatgaactgacagaagtcttaaaatcaatcgaagaagataaattcttcagcgcacataaaacaattcagatggatatcggtgctcatgtacttcctcattttacaaaggatacaaccgatagaaaccgtacatcaccatttgcatttaccggaaataaatttgaattccgtatgcttggttcttctgcatctgttgcaggtccgaacgttgtattaaatacagcagttgctgaggctctggcacagttctataaagaactggaaggaacagcaccggaagatatggaaacagcagtgcatgaattaatcaaacgggcaatcagaaaacataaaaaagtaatcttcaatggaaatggttatacagacgaatggattaaagaagcagaggagagaggactttataatctggtttctactccggatgcacttccacagtttatcgctgataaaaacattgaattatttacaaaacatagtgtatttacaaaagaagaaatttattctcgttatgaaattttacttgagaactatgtaaagactatcaatattgaatctaagactttacaggaaatgctgacaaaagattttattccggcagttaacggatatgcagcagaagttgcagtcaatgcaaatgaaaagaaagcattaattgagggtctgtcaacaacagccgaagaatctcttgtaaaagaattaacagaagcttctaatatcttatctgcaaaagtagcagaattaaaagttgtaacagaaaaagcagatgcggcagcagaagaagatatgcagaaagcagcagaatctttccataaagatgtattaactttaatggatgaaatgaaagatgttgcaaattcagctgaggaaaagattccagacgaagaactgccttatccaacttatgaccagatgttattttatgtttaaggagagggagtcatggaattcttaccagaatgtgaaataaaagaagaatgtggtgtatttggaatttttaatccggatggcggagatgttgccccatctatctactatggactgagttcacttcagcatagaggtcaggaatcctgtggtattgcagtctgtgataccatgggaccaaaaggcaacatgaatgcacataagggtatgggacttgtgaatgaagtatttaaagaagaaactttaaataatcttcacggaaatcttggagtcggtcatgtgcgttactccacaaccggagctgcaaatattaataatgcacagcctctggtattgaattatattaagggaacacttgcgctggctcacaatggaaatctggtaaatacagcagagcttcgctcagagttggaacgaaccggtgcaattttccatacaacaactgattcagagctcatagcctatttcattgcaagagaaagggtaaatgcccacaatgtagaagaagcaattcttcatacagcaaaaaaaattcgtggcgcttatggattggtaattgccagtccgcgtaaactcattggcgtcagagaccctcttggcttaaaaccactttgtctcggaaaacgcgatggaagttatatgattgcctctgaaagctgcgccctttctgcaatcggcgcagaatttatccgtgatatccgtcccggcgaaatcgttacgattaccaaggacggagtcacatcgaattgtcagctttgccaggaaaaaagagcacattgcatttttgagtacatttattttgcaaggcttgacagtacaatagatggtattaatatttacgatgcccgtattcgtgcaggtgccgcacttgcggctgcttatcctgtcgatgcggatttggttgtgggagttccggactcaggtattcccgcagcgaagggctattcagaagcttccggaatcccgttcggaatagccttttataaaaacagctatgtgggaagaacatttattaaaccgacacaaaaagaacgtgaatccagtgtacgcttgaagctgaatgtattagagccggttgtccgtggaaaacgaattattttagtggatgattctattgtccgtggaacaacaatggcaaatctgattcggatgctcaagaaagcgggagcagtaagcgttcatgtacgtgtgagttctccgccgttcctgtatccttgctactttggaacggacattccatccaacaaacaacttattgcgtcttcccacacagcagatgaaatcagagagataatcggtgcagagtcacttggttatatgaaattagaagacttgcagtcaatggtaggagaactgccaatctgcagggcatgtcttgatggaaagtacccgatggatattacaggacataccgaggacaaaaaacagtaattgcggaaatgtaaggcattttccgattacatatatcacattcgatacctggaaattgctggtctaaaaaacagcttttagactttcgaccctggtatcatcacatttttctttatgcgacggtgcgtattttgtgagagcaaagtgcgcacctttttgtattttagaaaaatgttgtataaataaaatttagaaaaatgtgagcttgaggaaaggggaaattaatatggattattcagcagtaaatacgatatgggtgcttcttggcgccgcattagtattctttatgcaggctggtttcgctatggtagaaaccggttttacccgcgcaaaaaacgccggtaacattattatgaaaaacttaatggacttttgtatcggaacaccggtcttctggctggttggtttcggaattatgtttggtgcgggaaatggcttttttggttcgatttccggtatcgcttcagaaagtaattatggaacagcaatgcttccggatggagttccgttttgggcatttctgatttttcagacagtattctgtgcaacatctgcaacaattgtttccggtgcaatggctgagagaacaaaattctcatcttactgcatctacagtttcttaatcagtttagttgtttatccggtatctggtcactggatttggggcggcggctggttagcacagatgggatttcatgatttcgccggttcctgtgccgttcatatggtaggtggcgttgctgccttagttggtgcaaaaatcttaggacctcgtattggaaaatattcaaagagtggaaaatcaaaagcaattccgggacataacctgacaatcggtgcacttggtgtatttatcttatggttctgctggtttggatttaacggtgcatctaccgtttccatggaaggcgatgcaattgtaaccgcaggtaaaattttcgtaacaacaaaccttgcagctgcagttgcaactttaaccgtacttgcaatcacatgggtaagatacaaaaaaccagatgtatctatgtccttaaacggttccctggctggtctggtaggaatcaccgcaagctgtgataccgtatctccgacatctgctgcaattatcggtatcttagccggatttgtagttgtatttggtattgaatttatcgacaaagtatgtaaaattgatgacccggttggtgctgtcggtgtacacggaatgtgtggtgcacttggaaccctttgtgtaggtcttttctctgatggaacaggtacagagtggaaaggacttttcacaggcggtggatttaaattattagaagttcagtttatcggatttatcgcaaccgttgcatgggttgttgtaacaatggttatcatctttaatgtattaaaacataccgtaggtcttcgtgtatctgccgatgaagaaatcgcaggtctggatatcagagagcatggtcttgcaagcagttatgcagactttgttacaacagataacatgggcggtggaaatgttccaaacgtaatgggaataaagagaggaccggtagaatctccggctgcaactcaggctccggcagaactggtgaaagatccgaaagttggtaccgatgtacataaactgacaaaagtggttattattacacgtagaaataaactcgatgactttatgcaggcaatgaatgaaatcggtgtaacaggtgttaccatcacaaacgtattaggctgtggcgtacagaaaggtgcaaccgcttactatcgtggtgttgaaatggatatgaacctgcttccgaaagtaaaaattgaaatcgttgtaagcttagtaccggtcgaaaaagtagtggaagctgcaaaagcagtgcttcataccggacagattggtgacggtaaagtcttcgtatatgatattgaaaatgtagtgaagattcgtaccggagaagaaggttatctggcacttcaggatacctcggaagagtaaaaaagttaaaaaaaaagaccatctaaaaaaagatggtctttttctattgacaagaaaaatcgagattgctataataccaaacataaatgaaagaacaaaggcgttcttatttggagggtaaaactctctaaataagagcgccttttttgttgattgaataaaaaaacaactcgtaagagagaggagattatgcatggaaaattacacgaaggaagccatattgcagatggcagaagaggaagatgtcgaatttatccgtcttcagtttacagatatgttcggatgcctgaaaaatattgcaattccttacagtaaactggagaaagcgatggataataaatgtgtgatcgacgtttcttctattgaaggatttgtccgtgatgaagaatatgacatgtatttatatccggatttatctacgttttccattttaccgtggcgtccacagcagggaaaagttgccagatttgtgtgcgatatttacaacgaagacggcactccttatatagaaagtccaagatatattttaaagaaagcattagaaaaagcgaaagcaaaaggttataccttgatggtcaatccggagtgcgaatttttcttattccataccgatgataatggaatgccgacaacaacaactcatgaaaaagccgggtatatggatttgagtccgattgatttaggtgagaatgcaagaagagatatggtattaacattagaagaaatgggatatgatattgaatcttctcatcatgaaattgcaccgggacagcatgagattgattttgaatattctgaggcgatggaaacagctgataaggtcatgacctttaagacagcggttcgtaccattgcaaaacgtcacggactgcatgcgacatttatgccgaagccgagagccggagtgaatggttcagggatgcacgtcaatatgatgttaatgaaagatggaaaaaatgtattcaccgacaaaaatgatgaacttggattaagtaaagaagcgtatcagtttatggccggtatttttgctcatatcaaaggcatgaccgcaatttgcaatccattggttaactcttataaacgtctggcaccgggatttgaggcaccgtctgatattacctggtcttcgagacagagaactgcactgatccgtgttccacaaaatgtagaaggtggaaccagattagaactcaggagtccggatgcatcttctaatccatatctggtactggcgctttgtctggaagcaggtcttgacggaattgagaaacagatggaactctcaccggaattaaaacgaagcataaggaaattaaacaaaaaagaaaaagaagaaatgggaatcgattccctgcctgagaatttaaacgatgccttaaatgagtttcatgcagatgaattggtcaaagaggtattgggaaaagattttacaaaatattatctgaaagcaaaaaaagaagaatggttagaatacatggagcaggtatctgagtgggagcttgaacagtatctgtaccgtgtgtaaaaaataaagagcaggaggcagtacatgagcagcatcattattgtattaccaaaaatcgaagatgcgaaaaaaatcaggaaaatactgatgcagcatggatttgatagtatcataccatgcgctacaggtgcctctgcccttatggaaatgaataaacagtccggagggcttgtaatcagcggatataaacttccggatatgtattacaccgaactcgcagacatgcttccgagtttttttgatattttattgattggttcagcaaatgtggtaagttccgcacagtcaggaatcatggcagtcacaatgccgattcgggttcatgaactggttaacaccgtggaaatgcagatgatgcagattcagcgtcgtttaaagaaacagaaaaagaaaccaaaaccaagaagtgagagggagcagaattatattcagaatgcaaagcggcttctgatggacagaaaccatttgacagaggaagaagcttacagatatatacaaaagtgcagtatggacagtgcaaccagtatggtcgagactgcacagatgatattgactttaatctatgatgaagtataagcataaagacaagtataagcataaaggagaaatgtgatatgtttacaattaatgaaaattatctgaaactgccgggaagttatcttttttctaacattgcaaaaaaggtaaatgcgtatcaaagtgaaaatccggaggcacagattcttcgccttggaatcggagatgtcacacaaccacttgcaccggcaatcattgaggctctgcataaagcagtagatgagatggcaaatgcagaaacctttcatggttatgcaccggaccttggttatgaatttttaagaagtgctattgcaaaaaatgattacaaagaccgaggctgtgatattgcagcagatgaaatctttgtatccgacggtgcaaagtgtgattccggtaatattcaggaaatctttggcttagacaacaaaattgcagtatgcgacccggtttatccggtttatgtagacaccaacgttatggcaggaagaagtggggaatataatccaaatactcagaactttgatggcatgatttatatgccgtgtctggaagcaaatgattttgtgccggagttcccaaaagagaatccggatatcatttacttatgtttcccaaataacccgaccggtgccacaattaccaaagcacagcttcaggaatgggtagattatgcaaaacgtatcggtgcagtgattatctatgatgcagcgtatgaagcatatattacagaggaagaaatcccacacagcatttatgaatgtgaaggtgcaagagagtgtgcaattgaacttcacagtttctcaaaaaatgccggatttacaggcgttcgtcttggatataccgtagttccgaaagatttaaaatgcggtgatgtacagcttcattctttatgggcaagacgtcacggaacaaaatataacggtgctccgtacattgtacaaagagccggtgaagccgtttattcagatgccggaaaagctcagttaaaagagcaggttgcttattatatgcagaatgcaaaagtgatttatgaaggcttaaaaaatacaggatattccgtatccggcggtgtgaatgccccttatatctggttaaagacaccggataaaatgacttcatgggagttctttgataagttacttcatgaagcaaatgtagttggtactccgggaagtggatttggtgctcatggagaaggatacttccgtttatcagcattcggaagtcatgaaaatacaataaaagcagtagagcgaattacaaagatgtaataacaggcgtgagaacgcgtgatttgcgtcccggggtctggatgccccgggatgtctgtttttaaaaacgcgataaaggagaaatgtgatatggaatttgttacaggtgtaaaagaaaaagaagcaatggaactgccagaagtgatcatacaggaagaaggaacagaagttatcgtagagggtgcaattcacagtatccgaaatatgggtgagattgcatttgtcatcttaagaaaaagagatggtctcattcagactgtatgggaagaaaataagacaaatctggatatctctgaattaaaagaagctgcctgtgtcagtgtaaaaggagtcgtaaaagacgaagaaagagctccgcacggaaaagaagttcgtctggaacaaattaccattttatcacagccgactgctccgcttccacttgcgattgataaatggaaattaaatacctcacttgaaacgaaactggatatgcgttcggtttctcttagaaacttaaaagaaagagcgagatttaaaattcaggaggcaatctgcagaggatttcgtgagtatctttatgcacaaggctttacggagattcacactccaaagattggggcaaaaggcgcagaaggtggttccaatatgtttaagttaagttatttccatacaccggccgtgctggcacagagtccccagttttataaacagatgatggttggggtgtttgaccgtgtcttcgaaaccggcccggtttttcgagcagagaaacacaacaccagacgtcatttaaatgaatataccagtcttgattttgagatgggatacattgacagtttccttgatatctgtgaaatggaaaccggatttttgcaatatacgatagaattattaaagaaagattatgcaaaggaattaaagatgcttggaatcacacttccaaacgtggaaaaaattccatatgtccgctttgatgaagcaaaacgtctggtatctgaaaaatataacagaaaaattcgcaatccatttgacttagaaccagaagaagaagagttaatcggtaaatattttaaagaagaatatgatgccgattttgtatttgtcacccattatccgtcaaagaagagaccgatgtatgcaatggatgacccggaagatgacagatataccttaagctttgacctcttatttaaaggacttgagatcacaaccggaggtcagcgtattcatgattataacatgctggtagaaaaaatcgaaaagagaggcatgagccaggaaggaatggaacagtacttagataccttcaaatatggcatgccgcctcatggtggacttggaatcggactggagcgactgacgatgcagcttttaggagaggacaacgtaagagaagcatgtctgttcccaagagatatgaaacgtttggagccgtaagaaaggagaaacagccatggcaaagcagataattgatgatacagtaatggaaaatgtagaaattcttgcaaaacttgcccttacggaagaagagcggaagaaagcaaaagaaaaaatgcaggaaatgctggattatgttgataaattaaatgagttggataccgatggaattgaacctctgtcccatacattttctatgggaaatgtattccgtgaggatgtagtcaccaatggagatgacagggatgcaatgcttgacaatgcaccaaaatgcaaagacggacagtatcaagtgccgaagacggtacagtaggaggaaagggtatggatttgaaagatttaagtgctcttgaactttccactgcgattaaaaaaggagaagcaggtgtggaagaagctgtaaaggtgtcactcgaacagataaaaaaatcagaagacactgtacatgcatttcttgagacagatgaagaaaaggtatatcaaagagtaaaagaagtagaagcaggaattgcttccggaaaatatagcggaccgcttgcaggtgttccgattgcagtcaaagataatatctgcacaaaaggcagaaagacaacttgtgcatccaaaattcttggaaattttgttccgccttatgatgcagaagccgtgaaaaaattagaagaagccggaatgattattcttggaaaaacaaacatggatgaatttgccatgggaagtaccagtgagacatctgcatttggaattaccacaaatccatgggatcagacaaaggtaccgggtggatcttctggtggttcatgtgccgcagtggccgcaggagaggctttcctggcacttggttcggataccggtggttcgattcgtcagccatcttcttactgtggtgtggtcgggatgaagccgacttatggaacggtttctcgttatggattgattgcgtatgcctcttcacttgatcagattggaccggttgccaaaaatgtggcagactgtacggctttattagaggcaatttccggatacgataaaaaagacagtacctcgattgaaagaaatgatttgaactttacagaagcgttaaacggcgatttaaatggggttcgtgtcggtattcctattgaatatctttcagagggactcgatgaagatgtgaaaaaaacacttcaggaaaccgtagaactgatgagggcaaacggagcagtggttgaagaattttctcttggactcgttgactatgtgattccggcttattatatcattgcttccgctgaggcaagttccaacctggcgcgttttgatggcgtaaaatacggttatcgcgcagagaaatttgaaggacttcatgatatgtataaaaagagtcgtgcacagggatttggagaagaagtcaaacgaagaatcttacttggttctttcgtattaagttccggctactatgatgcgtattatttgaaagcattaaaagtaaaagccatgattaaaaaagcatttgatgatgcatttgcaaaatatgatatgattctggcaccggcagcaccgtctaccgcaccgaaggtaggaagcagtttacaagacccgcttaaaatgtatttaagtgatgtctacaccgcaggggtaaatctcgcaggtcttccggcaatcagtgttccggcaggaaaagacagaaatggaatgccggttggtcttcagtttatcggagactgctttaaagaaaagaaaattatacaggcagcttatgcttatgaaaaaatccgtggagtatttcctatggcatatcagaaggagggaaaatagatggcaaaacaatatgaaacagtcattggacttgaagttcatgtagagcttgccacagcgaccaaaatcttctgcggatgctctacgaaattcggaggcgcaccaaatacacatacctgtccggtctgcaccggtatgccggggtctcttccggtcttaaacaaacaagtggtagaatatgcacttgcacttggacttgcagcaaactgtgaggttaatcagaactgtaaatttgaccgaaagaactatttctatccggataacccacagaattatcagatttctcagttatatctgccaatctgccatgatggatttctggaaatccagaccaatgcaggaacaaagaaaatccgtattcatgaaatgcacatggaagaagatgcaggtaaattaatccatgatgaatgggaagactgctccttagtagactataaccgaagtggggttccgcttgtagaaatcgtatcggaaccggatatgagaaatgcagaagaagtgattgcatatctggaaaaattgagaatgatttgtcagtaccttggtgtgtctgactgtaaattacaggaaggttcgatgcgtgccgatgtcaacttatccgtacgtgaagttggcacagaaacctttggaacaagaacggagatgaagaacttaaactcctttaaagcgattgcacgtgcgattgaaggagaaagagaacgtcagattgaactcatagaagaaggaaaagcggttcagcaggagaccagaagatgggatgacaacaaggaatattcctatgcaatgcgttccaaagaagatgcaaaagactaccgttacttcccagaccctgatttaccgccggtctttatcagtgatgaatggataaaacgtatcaaagacagccagccggaacttcaggaagcaaaatctgcacgttatgaaaaagagtatggactttccgtttacgatgcttcacttttaacccagtccaaacatcttgccgatttatttgaagaaaccgtaaaagaaagccagaatccgaaaaagaccgcaaactggtttatcggtgaaaccctgcgtctgttaaaagacagaggaatggaagcagaagaactgcattttactccaaaacatctggcagatttaattcttatggctgaaaaaggagaagtcaataaccagaatgcaaagaaagtctttgaaaagatttttgatgaagatgtagaaccgaaggcttatgtagaaacaaatggattaaagaccgtagaagataccggtatgcttgaatctgttgtcgataaagtacttgcagataacccgaaaactgtagaagaatatcatagcggaaaaacaaaagtgcttggattcttagtcggacaggttatgaaacagatgaaaggcaaggcaaatccggcgtctgttaataaaatgctgatggagaaactgtgattaattgcatgcctgtttcttttaccgaaacagtagaaattatttttggagccatagaatagtagaaattgtattttaaaaatattggctagttcggggacagaaatcttgtccccggacttttttatttcataggattctttttatgtgctatgcttcattcttctcattctgctcaaccagataatccagtgaccgaaactgataccccatctcttcccatttgccaagcaattcatctagaatttgagcattggttgatgaggtgctgtggagcagcacaattgcgccggggtgaatccggttaagcagtttgtcgaaggcttcttcttttgagggctggttatcctggtaccagtctacataagcaagactccagaagaaggttttataacctaaatcttttgccatttttaagttggtttcgctgtatttgccttgaggagggcgataatattttttcatttcctgtccggtagcctctttgtataaatcagaaagttcctgtaattcttttgagaaggaatcaatggaagaaatctgagacatatccggatggtgataagaatgattgcctacgatatgtccgtcggaaatcatgcgtttgacaatttcaggacttgtggagagaaaatttccaacgacaaaaaaggtcgcaggggcattgtgcttttttaaagcatctaaaatgatttcagtattgccattttcatatccgcagtcaaaggtgagataaatatttttttcatcggtgtcttgtgcatagtaggcgtcatattgctgtaattcttcgatagaggcatttccgacaggacgttttccttcttcctgaaagcttagcccccagttgccgactgcattggaaatggtttcctgtgcggagtaatagtggatggcaaagcttaaaaaatttccaaatgcaaaagaagcagtaagcaataaaaaaagtgcaagatactttaaaataaaatttctatgtaacataaaaaatcctaaatgcattgttgttacctaatatattgagaaaaaaggaaaaatatcacagaaaaagtgagattgcgaaatcctcaaaatcatgttagagtaaaaaaacagaagagaaagataaagagaggagaacaaaggtgaatagaaaattaattttctttgatatagatggaacaattattccggaagatacaggagtaattccggaaagcacgaaagaggcaattaaaaaagcaaaagaaaacgggaatctggtttttattaatacaggacgtacttttagcggaattacccagccgatttttgatttggaatttaatggttatgtctgcggatgtggaacgcatatttattttgatggaaagaaaatctattcctctgtgattccgaaagaaaaatgcattgaaacggtagctattcttcgaaaaaataaagtaaatgctttttacgaaggagacaagggaatttattttgattacagctattcgaatccgtttatggaacgggcaaaaaaaatgcttagaacgaatggtaaatcggttgaagtgatattagaagataaggatgaagtatttgataaatgcctgattaaattcacagatgaggatatcaataagaaagatatcattatgccattttttgaagcaaattattattgtattgaccgtggagaagatatgtgggagatggcacagaaaggtcacagcaaggcaacaggaatccagaaagtctgcgaatatcttggggcagatatcgatgactgtattgcaattggcgacagcaccaatgaccttgatatgttaaaggcagtaaaaaacagtgtggcaatgggaaattccatggagagcattcttccttactgcagttataagacaacagatattaaggaagatggaatttataatgcactggtatattttggaattatctaatgtttccggtagattgttttttcaaggtttagatattcgcgaaactttcttggagtatatccggtcatttttttaaactgattgctaaaatcggcagcatctttaaagccacaggaataagcaatttctgtaatgctgtagtctgaagaagaaagcatatcagatgcaatgtggattcttaattgaagcagatattgtttcggagaaattttctgctgttccataaaaagacgatagagataagtccgatcaattccaatagcggctgcaatgtcctgaatacggatgttgtagccgtaattatttttcatataatccattgcgcgttttacatattgagtggaataagagtttccttctacaacagacggaccagtcatcaaaccaagaagttcaagaaacaaacctgtcagagtaaaaggattatagttggctgaagagaaagtatttaagatagaatgcatcagagtccgcagattcaactttcgttcagaatcaggaggacaaataaaaatacaggagtcctgaaaacaggtctggtttaaaagggcagggatttcctgtccattaaagccaatccatgcatattcccagggattggtttggtcggcttcatagtaggtagagtccattggtttgattagaaaggagtctccggacttgagagaatacgtatgtccttgatgtttaaaaataccttttccggaaagtacaacatgaatcaaataatgaggacgtacggcaggaccgaaagagtgtccgggctggcagtgttcgtgaccacaaaaataaatagatggaattccggacagagactggttcataaataaaatcctccattttacaacatttttacaagttttgagaaacaaatcagatagaaagtccttttctttgattatataataagaatcataaaaagacaacggattatgataaaatcaaggaggatgaaaaatggcaaaaataacgtttatgggagcaggaagcactgtttttgcaagaaatgtattaggagactgcatgtgtagtgaagcactctgtgaaagtgaaattgcattatatgatattgatgcaaaacgtctggaagattcagagattattttaaatgcaatcaacaaaaatgtaaatgagggccgtgcacagattaaaacatatctcggtgtggaaaatcgaaaagaagcacttagaggagcagattttgtggttaatgcgattcaggtgggaggatatgacccttgtactattacggactttgaaattccgaaaaaatatggtttaagacagacaattgcggacagccttggaattggcggaattatgagaggtctgcgtacaattccggtgatgcaggaatttgcaaatgatatcgaagaggtatgcccggatgcattatttttaaattatacaaatccaatggggattttatccggctatatgcagagatatacaggggtaagaaccatagggctttgccacagcgttcaggtatgctcaaaagatttattgacgaagcttggcatggaagataaattagaaggtcgtgtggaaacaattgccggcattaatcatatgggctggctgttagatatccgtgataaagatggaaatgatttatatccggaaatcagaaaaagagcagccgagaaaaatgcaacagaaaaacatgatgatatggtacgttttgagtatattaaacgtttgggttattattgtacggaatcaagtgagcacaatgcagaatacaatccattctttatcaaggcaaaatatccggaactaattgaaaaatacaatattccgttagatgaatatccaagacgatgcatcaagcagatcgcagaatgggaagaagagaaaaacaatatcttaaaagacggaaagattacccatgagcgaagcagagagtatgcatctcatattatggaagcagttgtaaccaatcagccgtataaaattggtggaaacgtaatcaataaaggcatgattgaaaatcttccggcggatgcctgtgtagaagtaccgtgtatgattgacggaaatggagtcaatccatgcagagtcggaagacttccggtacagctggctgcaatgaatatgacaaatatcaatgtacagctgcttaccattgaagcagcagcaacgaaaaagaaagaatacatctatcaggctgcgatgcttgaccctcatacagcaggagaactttgcattgatgatattgtaaaaatgtgcgatgagttaattgacgcacatggagattatatgaagatgtataaatagtgataaagtttcgcattgacttgacggaaatcgggtatcggcttataatcaaattcacctgaaaaaggcagttggaggaatatgattatggcaatgaatccagtaaagttaatgcagataaaagcgacaattgccggagtagagaggcggcatccgaatcttcgaaagttttttgaggcagttggaagagaaaaattaagagaaggaacgattttggaactgaaggtgcagacaccggaagggaaaaagctgatttccaatgtaaaactgaccaaagaagatgaaaaattaatttcagagctgttaaagaataaagacaccttgctttaaaaaagcaccttgcttaaaaagcagggtgtttttttcttgacaaaggtaagaattgggagtaatataatgctaaaatgttcacgaaaattaaaaaggtggattacatgaatatacaagaatatgatattatgaacgaaatcgcagaaagcggttatgaaaatcagagaattttaacagaaaagacaggatattctcttggaaaggttaatcagtccttaaatgaattgattcagaaagagtatcttaccaaagaatatcaattaacagaaaaagcagaagcggagtttgaaaagaaagctccgaaaaatgcaattattttggcagcaggttatggaatccgaatgatgccgatgaatcgggaagtgccaaaggggttaatcgaggttaatggagaaccgttgattgagcgcctgattcgccagcttcatgaagccggaatttttcagattgatattattgtcgggtttatgaaagagcagtatgaatatctgattgatgaatatcaggtgaatctgattgtcaatcgtgaatatgcccagtacaataatcttcattctctggcacttgcaaaagacaggatttcaaatacatatattattccgtgtgacgtctggtgtgaaaaaaatccattttccaaaagagagctgtattcctggtacatggtgacagatttggtggatgacgaaagtgatgtcagagtcaatcgaaaattagagctggtttcggtagatgcagaaaaaagcggaaatgcaatggtaggcattgcttatatccttgaagaagaagcagaagaacttcagagccagataaaagaaatgtgtaagaaaaaagcttatgaaaacgtattctgggaaagcgctctaatgaaaaaaggtaaaatgtatgtatcagcgaaaatcgtgccgtcaagaagtgtttatgagattaatacttatgagcagttaagggaactcgatgacacgtcaaaacagttagactcagatgtgattcatttgatttctgaaattttggcatgtgagccgaatgaattagaagagattgaagttctaaaaaaaggcatgacaaatcgttcttttatgttcaagtgcagaggcaaacggtttatcatgaggattccgggtgagggaacagaaatgctgattaaccgaaagcaggaatatgaagtttatcaggtaatcaaaccgcttggtatctgtgattcgattcgatatatcaatccggaaaatggttacaaactgacagaatttatcgaagatgcaagatgctgtgattccggaaacccggaggatgtaaaagcatgtatggcggtgctccgtaagtttcatgaaagcggggtaaaggtggaacacacctttgatgtttttgaacggttggagttttatgaaaaattgtggaagggaattccgtcctgctatcgtgattacaagcaaaccaaagcgcatgtatatgaattaaaaaactatattgataagcaggaaaagcagatttcactgtgtcatattgattctgttccggataactttttaatgaccaaagacagaatcgcattaattgactgggaatatgcagggatgcaggatacagatgtggatcttgcgatgtttatcatttattccatgtacgggaaagaacaggcagatgctttgattgatgcatattacacagaaggatgcaaaaaagaaaaacgattaaagatttactgttacgttgcagtctgtggtctgttgtggagtaactggtgcgaagtaaaataccatgaaggtgttgaatttggcgagtattccttaagacagtaccgatacgcaaaagaatattataaatatgtaaaggaagaactggaaaatggcttataaagtagaaaatgcagttattatggcagcaggattgtccagtcggtttgcccctctttcttatgaaaaaccaaaagcgctgattacagtcaaaggtgaggtgctgatcgaacggcagattcgccagttaaaagaggccggaatccatgatattgcaattgttacgggatataaaaaagaaaaatttgaatacttaaaagaaaagtgtcaggtgacacttatcgaaaatccagagtatgcaaccagaaataataatggttcgatttattcggcaagagaatggattgggaatacttacgtgtgcagtgcagataattatttccctgaaaatccatttgaatcggaagtagaaggcagttattattcggtactttatgccgatggggagacgaatgagtggtgcgttacagaagatgaaaccggaaggattacttcggttaaagtcggaggcagagactcctggtatatgatgggacataccttctgggcagagccgtttagcaaacgcttttttgaaatcttagaagccgagtataacaaaccggaaaccaggaataaattatgggaagatatttatattgaacatatcgaagaactctcgatgaaaaccagaaaatataatcaagatgaaatttatgaatttgattctttagatgaattaagggagtttgatgagaactataaaacaaattccggttcagaaattttaaaacaaatttcggaagaacttcagataaaagaaggcgaaattaaacagcttgttccggcaaaagatgagaatggactggtaaccggagttaagtttgaaatacaaggaaaacagtttgagtatgactatcagctgaaaaagctgatacatggaggaaaaatcaatgaataaattagatcgcaaaagaatagactggctcatcacgttagctccttttattagcattatgttattagcgggtgtattatttgtatttccaaatgagtccaataacattataagtaaggtgcgattttttttcggtgatacagtcgggatttattatttagtaattggtttggcagttttgctggtttctgtttatttagctttttcaaagtatgggaatgtcgtattaggcgagccaaatgagaaaccgaaatattcattttttgtatggggaagcatgatgtttacttgtggacttgcagcagacattttgttctattcatttgcagaatgggtaatgtacgcaactaatccgcatatggaagaacttggctccgtggcagaatgggccggcgtttttccattgtttcattggagctttattccgtgggcattttatctggtacttgcagtcgtattcggttttatgttacacgtgagaaaaagaaatcgtcagagatattcggaagcatgtcgaccagttattgggaaacatgcggatggtgtgttgggacgtgtgattgacttatttgcattatttgcgctgcttgccggaaccgcaacgacatttagtgttgcaacaccgcttttggcagcaattattgtaaagctatttggtatcacgcttagccgaacagttgttacaatcatcattttattggttacctgtgcagtatatacttatgcagttttgcatgggtttaaaggaattagttttttggcgaagctgtgtatttatcttttctttggcttattattgatcgtgttgctaatcggtggtcaggggaaatttatcattgaaaatggcttccaaagttttggaaagatgttacagcattttatagagttaagcacatttacggatccggaacgcaccagtaatttcccgcaagattggacgatttattattgggcctattggatggtttgggcagtcgcagctccattctttattggtaacatttcacgtggcagaacgattaaacaaacgattcttggaggatatgtgtttggtgttggatcaacaattattagttttgtcgtacttggaaattatgggcttgggcttcaagtgagtggaaaagcagattttatttcccaatatgcgaaagatggagatctttacggactcattttgaatattatagatacaatgccgctggcaaaggtgattttagtaatcacagtgttatgtatgattgcattttatgcgacttcatttgattcgattgcatatacggcagcttgttatagttacaaggagcttggagaaaatgagcatccgcataaactgattgaattattatggtgtttactattgattgtactgccgattgcgttagtgttttcggaaagttcgatgaataacattcagagtatcagtatcatttcggcatttccgattggcattattatgattcttattttgataagtttctttaaagatgcaggaaaatatttagctgaatcaagtaaatctcctgattcaactacgaaaagcaagaagtagtgggtagagacttgctttttgtagagaacggtaaagaactggagaatttgatatgacacttatacagttaaaatatattttgacaatagcagaaacaaaatccctaaataaagcggcagagcagctttatgtttcacagccttctctaaccaatgctctgaaggaactggaaaaagaaattgggattacgattttttttagaagtggacgtggtgtaacactgacgaatgatggcgtggaatttttaacctatgccagagagctttatcatgagtatgaacagttactgcaccgttatacagaaggcagttcttataagaagaaattcgcagtttccacccagcattattcctttgcggtcaaagcgtttgtggacgttgcaaagacgctggatatgtcacagtatgaacttgcaatccgtgaaacaaagactgcagaagttattatggatgtcagcacaatgaaaagtgaaatcggggtattatatttaagtgactttaaccgcaaatccatggaaaaactcttaaactctgcaaatctggaatttcatcccttaattgagtgtgatgcttatgtttatttatggaagggacatccgttagcggaagaagcatgtattacgatgaagcagttagagaattatccatgtctggcatttgagcagggagacaacagttccttttatctttcagaagaattactgccgacaaatgaatacagtcagattattcatgcaaatgacagagcgacgatgctgaatttgatggtgggcttaaatggttatacgctttgttccggtctaatctgtgaagatttaaatggaaatgactatcgtgcagtaccgtttaaaaatagtgaaggaccggaagaaaacaaaatggaagtcggatatgtgacaagaaagaatctgattttaagtaaattaggtgagatgtacgtaaatgcattaaaagaatatctgaaaacggaataacgaaaggaatcatgaaatagccagttatagttttaaactataactggctattctttttgtgtattagacaggtggtttttgttatgttaatatcaatggcatgtaaaacatattaaacaggtatgaaaataggaatataaaaacaggaggaaaaacagatgacggatgttctgattattggaagtggtccggccggtatgacagcaggcatttacataaaaagagcaaacttagatgtgcagataatagaaaaagaatatgaaggaaccggtcagatggcagagagcagccgcattgataattatcctggattttatggaataagcggttatgacctgggagagaaaatcagggagcatgccgaaaatttagagattgaatttttagaagaagaagcagttgcctttgaagagaccaaaaaaggatttttggttatcctggaaagtggaaaaacactggaggcaaaaacagtgatttatacagccggagcagaacacagaaaattaaatgttcctggaagtgatacatttgaaaataaaggaatttcctattgtgcctcttgcgacggagctttttacaaagaaaaagacgtggtggtgattggtggaggaaacagtgcattggatgatgctttgttactttctgaaatttgtaacaaagtatatctggttcacagaagagataagtttcgaggcaatcctggaacacttgcaaaattagaagcaaaagagaatgttgaaattattcgaaatgcaaatgtccaggaaatcaaaggaacaaaaaaagtagaaactgttttgttagatacaggagcttcccttgaagtacaaggtgtgtttgtagcagtggggatgattccacagacagaaaaattaaaagacctggttgagttagatgaaaatggatatgtaaaagctggggaagatggaatgacttccaaaccgggattttttgtagcaggagatgtaagagcaaagaaacttcgacagattattacagcagcagcagatggagcaaacgcagcagattcagccattcattatatcatatagtagtacaacgtacgaatagaaaggaaacaatatcatggtaaatcaactgacaagagaaaattttgaaaaagtaataaaagaaaacagtattgttgttgtagagttctattctgcaacttgtaagcactgtaaaaagctggaggcaggaattgcagagctttccgaggaagccggaaatgaagtgtacttcggaaaagtattagtttctgatgaactggctctggcagacgaatatgaaatcacctcagttccgactttattatattttaaagacggagagattcgtgaaaaatcaattggctttacacataaactgattattgcagaaaacataaagaaattataaaagaacaggagtagatagattatgggatatccaagtatttttccaacaggaacattaatttatgataaagagaaaacatttaatggttatacgatttttccttccgcaaaaggagcattattaatcgatatgaatggtcgtgaagttcagctttgggcaggacttggcggatttccaaataaaattcttccaggcggatatgtaatgggaacaacaggaacaagacctggtaaaaaagcgtatcaggaccagattgatttggttcaggttgactgggatggaaatattgtctggaaatttgataaaacagaattgattgcagacggagataaagacccggtttacatggcaagacagcatcatgattatcaaagagaaggctctactgttggttattattatccgggcggagaaccaaagacagatagtggaaataccttaattttaacacatgaaaatctttacaatcatgatatttcagataaacgtctgattgatgacaagattatcgaagtagactgggaaggaaacatcttatggagctggagagcaagcgaccatttcgaccagttaggatttgatgaggcagcaaaaaatgcactgtttcgtaatccatgcctgcaaggtgaagccggtggtgactggatgcacatcaacagcatgtcagtcttaggtgaaaataaatggtacgaccagggagatgagcgtttccatccggacaacctgattattgatgcaagaaatgcaaatattctggcaatcatcagcaaagaaaccggagatatcgtatggcgtgtcggaccagattttaatgaaaacgaagcaaccaaaaaacttggctggattatcggacagcaccatttacatatgattccaaaaggacttccgggagaaggaaatctgctggtatttgacaatggtggagaaggcggatacggtactccaaaccctggagcattaacaggtgtcaacaatgcaaggagagattattcaagagtacttgaatttaacccgattacacttgagattgtatggcagtatactccacttgaagcaggaaatctgttatttacggatgcatctaaattttatagttcctacatcagtgcagcacagagacttccaaatggaaatactttaattacagaaggttctgacggacgtctcattgaagtgacaccggaacatgaaattgtatgggaatacattaatccatactttaataccatccttggacagtttacgaacaacatggtttaccgtgcataccgtgtaccttatgaatggattccacaggtagaaaaaccggaagaaatttctgttgaaccgattgatgtggaaaccttccgtgtgccgggttctttagttggaaatggacttggaaaagttaccacaatcgacggagtagacccagaagcacgcctgatgacaggtggcggagcctccgatgacgaagatgaagaagtgaacttctgtgtggcaaccgtaaagaaaagcgatttaattcataaataaatttaaggtcatgatacctgaaagggagtgaagaaaatgaaaagcaaaaaaattacagcagcagtttttggtcttgttcttacattaggtctggtggttacaggctgtggaagtaatagtagtaaagcagatgacggtgcgaagacggattcaggaagcaagaaagaagcaaatgcagatggatatcaggtagtcaatatcggtttcccgagtgccggttatgaatgggcagaaggtgcactggcaatagcagaagaaaaaggttatttggatgaatacttaaatccacttggatatgatgcagatttgattccatttacaggagctgcaccggcgattcatgaagctttggtatccggagatttggattatgcatattatgcaggatttgcaggaattatggcaaaatcaaatggaattgatacaaagttattggctgtaacaagctttggatctgcatggcagttagcggtcagcgcagattccggaatcacttccttagaggatttaaaaggaaagaccatttcctatcaaagaggtgcaactcctcagatgtatgtattaaaggtattagaagaagcaggtcttagtgcggatgatgtacagcttgtaaacagcacaattcctgaaggactttccagtctttctaccggtgcagttgatgcggcagttgttacttatggacaggcagataccttagtagaacagggaaaagcttctattattcataaaggggtagatgcagacgcagatacgttctatgaaccaagcgtgttaacaggaagaacagattttgtggaaaaaaatgcagatgtctcaagcgcaattattgaagctatgttaaaagcaagagatgatactattgcagacccggaagcattttacgaattgtcttctgaaaagagcggaagaacattagagcaggtgaaatctgtagccgtatctgatgtaaaacttgcttatccggtcagtctggatgaaagatatattacttcattaaaaaatattgagcagtttgaacttgataacgatattattaccagtcaggtagattttgattcctggattgattcctcctatctggaaaaggcagtgcaggactatcagggaaacgcacagtagggaggatacatgagcatgtacaaaggaaataacgtatttatacaaaaattattgctctttcttaatatgattatattgccggtactgattgtactggcatggcattttgccacttctaccggagcaatgtccacactgattctgccaaaaatcagtaccgtgcttgagacattgaaagaccagcttacaaatggtccgcttgccggagatatcggcattagtttaagccgtattgcaaaaggatatgcgctggcagttgtggtaggaattttacttggcgtgctcatgggaatgaacaaatttgcaaaccgttttttcatgctgacatttacagcgattcgtcaaattccaatgattgcatgggttccgattttaattatctggtttggtatcggagaagaatctaaagtagcagttatcttcttagccgcttatttcccggtactggtaaataccgtcagtggtattgaacgtacagacccgaaattgattgaagttggaaaaatgtatcatttaaatggatggcagcagtttacacagatttatcttccatctgctcttccttccatctttgtaggattaaaactgggattaagtgtatcctggatggcagtagtcggtgcagaaatgattgcagccacatctggtatcggattccgtatcaatgatgcaagaagcctgatgcagtatccgattgtatttgcaggaattatcgccattgcagtggttggtgtgattatggatttggccatctcactcattggtaagttatgcacaccttgggaaagaagcaggtaggaacatgggaaagaaaaagttaatcgttcatgatgtaaataaaagctttgtagttaatggacaaagcgtagatgtattaaaagatattaatcttgaaatagaagaaggcgaatttgtagtcatcgttggacacagtggatgtggaaaaagtacgttattgaaaatgattgcaggacttgagaaaaatgatacaggaattttaagtgtagatggaaaagaaatcgatggaccaggaatggacagaggaatgattttccaggaacatagattatttccatggatgagtatcgagaaaaatgtacagcttggtctaaaggggctgagcaaagaagaaaaaagaaaactttctgaccagtatctggagctggtaaagcttagtgaatttaaaaaagcatatccaagtcagctctcaggtggaatgtcacaaagagctgctattgcaaggtctttagtcagtcagccagaaattcttctcttagatgaaccatttggagcattggatgcgctgacaaagattgaacttcaggaagaaatgctcaagattcgagaacgctttcataataccatgattatggttacacatgatattgaagaagccgtatttctagcagaccgtatcgtggttatgtccgcaagaccgggacgaatcaaagatgtaatcaaggtagagcttggaaaatacagggaccgtggaagcacagacttcacacattataaaaagaaaatctttgattatttctttgaagaaaaaacagttacaccagaatacaatatttaaaaataaaccatgtagatgcctgagaaggatttacatggttttttgatttttggaaaaatgtgtaaaatcacgtcaaaaaagctggaaaaatgtgaaaaaaacaagaaaaaaattcggaaaaatgtgtaaaaatggatttgaaaagccggaaaaatgtattagcattaatatagaatgaatttaaaaggcggtggttttcaatgaaaagaaatgcaatgcaggatttagtacaatggaaaaacgatgaagaacggaaaccaatggtattaaagggagcaagacaggttggaaagacctggattatgaaagaatttggcaggcagtattatgagagttatgtatatttcaactttgatgaagaggaagagttaaaatccatttttgaaaccaataagaatccgtaccgcattattgaattgctatctataataattatttgattattgggggaatgccggaatgtgtagtttcctggataaaatataaagacccagccagagtttcgaggattcaaaaagagttaattgaagtttatgagaacgacttttcaaaacataatggaaaagtaaatagtggacggattctcatggtatttcgcagtattgtttctcagcttgcaaaatcaaatgaaaaattcatgtatagtgcagttcgtgagggtgcaagagcacgtgattttgaagaagcgattgaatggttagtatcagcaggtatggtgaatcgtatttataatgtgtctaaaatggagcatccactttcagcttttaatcgtttggaccagtttaaattatttgtattcgatacagggttattaaagtatatggcagggattgacaacagtgcgattttattaaattccagttatcagtttaaaggagcattgacggaaaattatatacttcagcagcttcatggtcagtttgaagttgaaccgcactatttttcttataagaatcaggagattgattttgtacttcagaatggaaattgttcctgttgaagtaaaaggcggtgaagataagtcagcgccgtcatttaaaaagtatgttcaggaaaaagaaccgaaaacagcgttgagattttcaaaaagaggatatcggaaagatggaaatgtcacgaatgtgccgttgtatctggcaaggaaaataagagagttgatgtgaaaagatgagtatgataatataaagtaaaatttggtgatgaaggtaggaattaaaaaatgtgttatctaattgctaaagacagagatgtgcatggatgcttcgcattaaaaacaaaacatggaaaacatttagcagaattaaaaagagaattaaatgaagcagttggctataaaggagttcagttagtaacaattagcagaccaacagcttatggagaatatgcaccgtattgttttgtggatacagagaaagagtttgaaactcttgtaaagtcattgcgttgatgaaaaatgtattaacgagaaaaccagccaatatacggctggttttttagtaaattattaaatggcaactttaaacattgctttctttattcgttctggtttctcaggagcaattcccgggcgatgagcatctgttggataacagataagaaaatcattctcttttaagaaaatcgttccatttgctgttccggagaacgtctcaaagtcatttgcctcgagatagttaagaggcttcatatttggtgtaaagttcacgtcgatttgttctgcaccttttaagatgaaatgaatatcaagaaatcttctatgagcttcccagcctttttcttctacagggacagtttcaaattccataatatttagatagacattatcgccatcaatttcgtaatgaccacagggaaaagaagcaaggtcgttattttttgcataatttaaacattttgcaatgccatctgcaaaatgagaaatatcgtttggtgtaaggttattaagattgtcgaaatacataaagagtccttctttcttttaaatttgtatgttatgctgttttaaagtattacgcaaaatagttgccatgatatcatagccttttccatttggatgaagaccatcataagtaatgccgtctaaaggaatactggcccccggatagcaggtaggggtatagtagttaacaaaaataagtccttcttgtcttgctttttgggtaagccagttattaaaatcttttataaaatcttttcgttccctttcatgtaaagaagttggcatgtaaattggcattaaagaagtaatgattaattgagtactggtttgttttgcctgatagataatgtcacagtaattttcttttgctttttcgagcacggcatcgtatggagcaggaggaattaatttccaataatctccctccaaattaattgtgtcattaattccgatgtccaaaatacaatatttcggttcaagctgtaaaacatcggtaaaaaaacgttttcttaaataagttgtgttgtctcccgcaattccccggttgataataaacaggttaggatttctgaaatatgcattgagttcccaaaaatgtgtaatggaatctcctgcaaaaatgaaatccggcttttgatttgagtacattaaagaatgatttttaatattaaattctttctggcggctgtcagcagccacaacttcagaatagtatccggcattgtgatttgacatatcagaacctccaaaagtaataatcttaagactgattatataatgaagaatcaatagaaaaaatggaatagacacttaataatagcataatgctgtcaaaaaacaatatttttgtattgattatagcttaggataagactatcatataagaggaggtgatttttttgaaacagggtgtggataatgtaaggtttaattttctttatgtggataaatattcttttggcagaacgtgggtctatccggagagtattgttccatacaatatgttaaggtatattcgctcgggtgcggctacattttttattgatgacaaggaaatatcggtagaaaagaatcagattatatatgttccgagaaattgtaaattgtcttgttatgcccaaacggataacttttcttttataagtatacgatttaccacatctgtattttttgaaggtggagattttctggcagattattacggagtaccattggtaacagaagcaaaaggcgaggaaaaatattttgacctgatttatgattatattaaaagtgaaaatccagccagaatttattttgtcagaggttatttggaaattttaattggaactttgatatccagagcagatgcagataactatggaatattaagaagaaacaagacggatgaggaatatactttggaaaaagtgagacagagaatccgtaaatcagataatcggattgattcgagaatacaggttgttgtagattatattgcacttcatcctacggaacactatacaccggagagtatggcaaagatggcggagttaagtaaacaaagatttagtcatttatttaaagagcaacttggaaaagcaccgatgacatatttaaaagagctacgtttaacaacagcggccagaaagcttttagtaacaaatgataatattagtgatatcgcatatagcgtggggtatgaagacccgaattattttacgagagaatttaaacacgcatttggatatacaccaaatcaataccgaaaagcagcgagagattagcatcaaagaatgagcgtattatgctattaatgcgacacgattgcggaaatgataagcttagtggagaaaaattgattaaaaaaaggcagtacagactagaaaaaacgtgactaatagaataaaaaacaactgaaacagcggagattgtagcaaaggtgatactttttaagcaggttgaaaagtaccaccttttaatgttgaaaaacgagcgtattgtgctattaataggttagagcttcattgaaaacgcctaaaaaaatacttataatgacaacataaacagcaatatgacgaaaaggacagagcatattgtaatggggctaggaaaaacaatttaaaaatcaccaaaatgagaagagtgaaaggagaacaatatgaaaaaaagactagcgatgctattggcgggagtaatgttgaccggcagtttattaacaggatgtggaggggattcatcagcgagtgatacaaactcagatgcaaaaaaagaagcatctaattcagatgaaactggagaattagagggcgacatcacattttggcattcctttacacaaggaccgagacttgagacaattcaaaaagcagctgataaatttatggaagaaaatccaaaagttaatattaaaattgaaacattttcatggaatgacttttatacaaaatggacaacaggtcttgcttccggaaatgtaccagatatgagtaccgcacttgttggacaggttgctgaaatgatcgattccgatgcaattattcctttaaatgatttgattgatgatattgggcgtgataaattccaggaaaatgcattaaatgaattaacagtagatggaaataattatgcagttccattatattcacatgcaatggtaatgtgggttagaaaagatttacttgaagcaaataatatggaagttccaacaacttgggatgagctgtatgaagatgcgaaggctttaacaaaagatggaatttatggattatctttcccatgtggaacaacagatttccaagcaacaaacttcttaaacttctatgttaagagtggaggcggaagccttttaacagatgatttaaaagctgacttgacaagtgatttagcaattgatggtattaattactggttaaaagtatacgaagactgttcaccgaaagattctattaactacgatgtattagaccaggcaaccttgtactatcagggaaaaacagcgtttgattttaactctggattccagattagcggtgttgaggcaaactcaccggatttattacagtatgtagactgctatccaattccaacaattaataaaggcgatgagcagaacggtattacaacttctaaccagccaatggttgtttggaaaaattcaaaacatcctgaaatttgtgaagcgtttattgaaacattatatgatgaagatacttatgttgaatttcttcatgcaacacctgtaggtatgttacctgcaattaaaggtatttctgatacagatgcgtataaagataatgacatgattaaacagtttgaacatgcagaatccgtaattgaaagtcagattccaggaggaacagcaattggatttgaacatggtccaagcactcaggctggcatcttaacaaatcagcatatcattgaaaagatgttccaggatattatcacaaacggaacagatgtagaagaagcagcgcaggcagcagaagatgaattaaatgctttatttgaagcagttcagtaagcatcgactgtattaacattataaagcaggaaatactttaaaattcctgctttataatttgaagagggtgaataaacaagatgaataaaaaaaattatactagatggctatttgtgcttcctgcgattatcattgttttggctttgtttgtatatccaattatatcaagcttttattttagttttacaaataagaatctgattcggcctacttatgattttgttggactcgataattatatagcagtattaaaagataaaggcttttggaatgcttttctcaattctttaaaatggacaattttttcacttggcggtcagttgcttgtaggatttacagcagctttggcacttaataaagtaaaacacttaaaaggtttttataaaacattattaattatcccatgggcgtttccatctattgttattgcgttttcatggcagtggattttaaatggggtatacggatttttaccgaacattcttgtacaacttggtctgtgtgatacgccgccacagtttttaacagatagagtgttggcgtttgtggttttagtatttattaatatttggtttggtgctccaatgattatggtaaatgttttagcagctttacagactgttccacaagaccagtatgaagcggcggaaatcgatggagcaaaaggatggcagtcattcttatatattaccgtccctcacattaaggttgtaactggattattagtagttcttagaacagtgtggattttcaataactttgatttgatttatctgattacaggtggcggacctgctggtgctactcagacagttccggtttatgcttatgatatgggatggggaacaaaattacttggaaaatcatcagcagtaacagtgctgttatttatattcctgatggctgtatgtgttgcttattttgcagttcttgcacattgggaaaaggaggataaatagatgaaacataaaggacaaaaaatacaaagctttatctgtcatttttatctgattattcttacgattattgcaattttcccattggtatggattatattatcttccataaaaggaaaaggtgagttaacaggaaatccaaccggatttttaccaaagacatttacattggaatatttcagacatgttatttttgacttgggattcattaataatattaaaaatagtgcaggaattgcacttgtaacaacattgattgcaattattgttgcagctttggcagcttatggtattgtaagattttttcctaaatttggaagtgtaatgtctaaagtgcttgtaacaacttatattttcccaccaattttattggcaattccatattcaattgttatggctaaggcagggttggtaaatacaagaattggtttgattattgtatatttatctttcagtattccatatgcggtatggcttcttgtgggattctttaaaagtgttccgattgggattgaagaagctgcaagaattgatggagcaaataaaattaaagtatttggaacagttgtacttccattggttgctcctggtattgtagcaaccgcaatttatacattcatcaatgcatggaatgaatttttgtattcattaattttgattaatgatacttctaagatgacagttggtgtggcacttcgttctttgaatggttcagagattcttgactggggagatatgatggcggcatctgtaattgtagtaatcccttcaatcattttcttctgtttaattcaaaacaagattgcaggtggcttaacagaaggttctgttaaataaaaaagaactaaaaacaacaatataaatcaaaaaaggagaagaaaaattatgaattacggtgtagttggagttggatattttggtgcagagctggcacgcattatgaaacagaatgaggatgcaaatattgtagctgtttatgacccagataatggaaagacaatcgcagaagaacttggatgtgatgcaacagagtctttgaatgaactggtaacaagagatgatattgattgtgttattgtagcaactccaaattatctgcataaagagccggttattgaggctgcaaaacatggaaaacatgttttctgtgaaaaaccaattgcattaagttatcaggattgtgatgaaatggttcgtacctgtgaagaaaataatgtaactttcatggcaggtcatgtaatgaatttcttcaatggcgtacatcatgcaaaagaattaattaaaaatggtgtgattggtgatgttttatactgccattctgcacgtaatggatgggaagatattcagccgagtgtttcatggaaaaaaattcgtgaaaaatctggagggcatttataccaccacattcacgaattagactgtgtacagtttattatgggagaaatgcctgaaacagtttatatgaacgcagataacgttgcacatagaggagaagcttttggtgatgaagatgatatgatttttattaacatgaagttttcaaatcatagatatgcagtattagaatggggttctgcattccactggccagagcattatctgttaattcagggaacaaaaggtgcaattaagctggatatgtttgatgcaggtggaactcttaaagtagatggaaaagaaacacatttcctgctgcacgaaagtcaggaagaagatgatgatagaacaagaatttatcatggaacagagatggacggagcaatccagtatggtaaaccaggtaaaaaacctccaatgtggttacatggtatcatggtaaaagaaatgaaatacttaaatgatattatgcatggaatggaaccagatgatgaattcagaccactgttaacaggagaagcagcgagagccgcaattgcaacagcagatgcttgcacaaaatcaagtgcagagggaagagttgtaaaggtaagtgaaattttgaataagtaatttaagatgatttttgactagtctaaagatgcaacaatagtgagcaagtaaattgagattcatattagaacatctttagactaaatttatattagatataaatctagaacatggaagaatgtttcaaaataaaaaatatgggtcgttaaattaaaacacggcagaatggagacaaatgaatagaaaattagtagcattatttttaagtcttgttatgagtatgtctacagccacagtttatgcagaacctacaaatgaagagacgcttcaaaaagaaaacattgagaatgtacaagaagataaaatatacaaaatggattggtatttgaacaaaataatattgatatagtgcagggacaagggtatgatgttagttctgaagaaggagcagagtatgtggaagccctatcggagggaacaattattatttctttcaaatcaaccagtcaaaatcaatatcagtcgttaatcagtataggaaacaatagaacgggaaatcaaaatagacattttcatctgtatataactaatacaggtgcagtaggaatggaattaagaaatacggattctgtatttaaatataccttaagtcgaccagcagctttgcgttctaaatataaaaatgagtatgtatcaaacactgttgcatttaaagctgatagagaaaatcatcaatataaattatttgcaaatggtgagttgcttgcaacattggacaaagaagattttaaatttataagtgatattacagaagtgaataatgtaatgttaggaggaacaaatagacaaggtacagtagcatatccgtttggtggaacgattaatagtgcgcagatatatcagagcgtattgagcgatgaagagttaaaagatattactggcgtcacaacttatggtaaaaatattttttatgaaggagacgctacaaattcaagctattttagaattccaaccatgcttactttaaaaaatggtcatgttgtaacttctattgatgtaagatatggaggaacacatgatgcaagaagtaatattgatattggattttcaaaaagtgtagatgcaggagaaacttggagtgaaccgactatgccaatgtgttttgacgactatgcagctgaacagattgactggccaagagattcagtaggaaaaaatgtccagataaatggaagtgcagcgtttattgattcaattcttatggaggatcaggagacaaatagactatttttatttgctgatgtagacccagctggaataggatttaataacagtagtgctggttcaggatttaaaacaattaataatgagaaatatgttgcattacgttggagcgaagataattctaatacttataattattctattagagatgatggagtgatttatgatgatacaacaaatcagccaacggaatattcagttgatggtaattataatatcttgaaaaatggagagtatttaacccaaaaacagtatcaagtaagatttgagggaactacattgattgaagaacataatgatgtggatgttaaacaaaatgtattctataaagattctgtttttaaagttaaacctgtcaattttgtaggaatgaagtacagtgatgacgagggtgaaacatggtcggatatgacattgttaggaaagtttaaaggggataatgaaagggttcctctttttggtccaggcgttggtgtacagataaaaaatggcgaacatgcaggcagacttattttaacaatgtataatagcaggtcggcagaattcggatttctctatagtgatgaccatggagcaaactgggaatattcgactacagatttaggtggaaacggaacatttgcagaagcgcagatagtagaacttccagatggaacattacaatcttatatgagaacaagtgtaggtaagataggagttataaccagtattgatggaggcacaacttggacaactcaatcgtatgtggatggaatgacagcagcatcgtatggaacacaattatctgtaataccgtattctggattagtagatggaaaaccagctattcttttatctgcaccaatggcaacaaatggaagaagaaatggtaagatatggataggtttaatcaatgatacaggaaaagaaggatatgataaatacgatattgaatggaaatattgctattctgtggacgatgacaaatatggattttcatatagttgtttatcagaaatgccagatggacaagttggaattttttatgaaaaatatgattcatggtcaagagatgaattgcatctgaaaaatattatgaagtttgaaaaatatacaattgatgagttaaaacaggaagttaagtaaataaagcaaaggagtttgtgatttggtaagtcacaaactcctattttggattaagtgttaaagaaaattatttatcaatcttactcagtgctgcttcatctgcaacgattgttacatcattatgtaactgcagaatagaagcaggaacttctggagtaattggcccgtaaagcacttcttttaagatgtctgctttatctgcaccacttacaacaacgaggattttctttgcctgcataatgtttttaatacccattgtataagcttgtttcggaacatcatcttcggattcaaagaagcgtttatttgcttcgattgtactttctgtcaagtctacgcagtgagtttctttttcaaatgcttcacctggttcattgaatccaatgtgtccgttatgtccaagaccaagaagttgtagatcaattggccctttttcctgaatgatttgattgtaatcattgcaggctttctgggaatccggttcaagtccgtttggtacaaaggtatgagtcttgtcaatgtttacgtggtcgaagagattggtattcatgaagtagcggtagctctggtcgttttctggacttaaacctttgtattcatccagattaatacttgttacctgtgaaaaatctaaatctcctttttcgtaccattcaatcaactgtctataagttccaactggtgaagaaccagttgccagtccaagtacacagtttggtttcatgatgatttgtgcggagataatatttgcagcttttctgctcatatcctgatagttttttgctttatagatattcatatctataccccttttcttttttgtaataattgtgtttttagctgtatttctgagtattagtataagaaatttcaggatgattttcaataaaatagggagaagttgggagtaaattagccattttggaacgataatcctattattgtacaaaattgctaaaaataaagcggtacaactaagagaaacatggataaaagtgaaaaactttgaaactaatttcataataaaacaactatattgaaaaaagtttcaaaaagaactatactttggacataacaaaggaggtcaaaaaaggatgaatcaaaaagtagaaaatctgaaaggaaaattaattgtatcttgtcaggcacttccacatgaaccgttacattcttcttttattatgggaagaatggcattggcagcgaaagagggcggagcaaaaggaatccgtgcaaatacaaaagaggatattaaagaaattcagtcacaggtagaccttccgattatcggtattgtaaagagagattatgatgacagtaaaatttacatcacacctacaatgaaagaaattgatgagttaatggaagtaaaaccggagattattgcaatggatgcaacgatttctacaagaccaggaaataaaacattagataaatttttccatgaggtgaaagaaaagtatccagaccagctttttatggcagattgttcaacggtagaagaagcacttcatgcagatgaacttggatttgattttattggtacgacaatggtaggttataccgaacagagtaagggtgataagattgaggcaaatgattttgaaattttaagaaaaattcttgcgagtgcaaaacacaaagtaatcgcagagggaaatattaatacacctgaaaaagcgagaagagtaatcgaactcggagcatatagtgttgtagttggttcgattatcacaagacctcagttgattacaaaatcatttgtagaagaaatggaacgataatatttataaattagagaatagaacaaaaaagcgaggagaaaaagctatgagaaatcttgaaaagtacaaaggtgtgattcctgcattttatgcatgctatgatgaagagggaaatgtaagtccagagggtgttcgtgcgttaacaaaatattttgtagaaaaaggcgtgaaaggtgtttacgtaaatggctcttcaggagaatgtatttatcagagtgtggaagacagaaaaattattctggaaaatgtaatgaaagcagcagagggaaaattgacagtcattgcacatgttgcctgcaataatacaaaagaaagtcaggaacttgcaaagcatgcagaaagtcttggagttgatgcaatcgcagcaatccctccaatttatttccacctgccggaatatgcaatcgcaaaatactggaatgatatcagcgaagctgctccaaatacagattttgtaatctataacattcctcagcttgcaggagttgccctgacacagtccttgtttacggagatgagaaaaaatccgcgtgtgattggtgtaaaaaactcctctatgccagttcaggatattcagatgtttaaagcagcaggcggagaagattatgttatctttaatggtccggatgaacaatttatgagtggacgtgtaattggagcagagggagcaatcggtggaacttatggagctatgccagaattatatttgaaactggatgaatatgtaaaagccggagaaatggaaaaggcaagagagcttcagtatgcatgcaatgaagtaatttacaaaatgtgttctgctcatggaaatatgtatgcagtgattaaagcaattttaaaaattaatgaaagtctggaacttggcggagtaagagagccactgccatcattaattgaagaagatatggaaattgtaaaaagagcagcgcagatgattcgtgatgcgaaagcaaaatatttataagtaaaatagttatttaagtagaaacacaatagaaaatacagaaaaaagagaaaggggcagaccgaaaagaaaggtttgtcccttttggggtatttggttataaagaagcggtaaaacggatggcttgagaaagtgtaagaaagtgtatataataaaaggaaagcataagaggaaaaaagagatgaaacagtacataagtattgatattggtggaacagcaattaaatatggtgtgattgatgaaaatgcacagattttaataaaaaaatctatggaaacagaagcctttaagggtggtcctgagattcttaagaaagcaattggaattgtagagaaattaatgaaggaaacaaaattagaaatttctggtatttgtatttcaacagcaggaatggtagatatcgaaaaaggttctattttctattcggctccattaattccgaattatgcgggaactcaatttaaagaagttctggaagaaaaatttaaaattccatgtgaagtggaaaatgatgtaaactgtgcaggacttgcagaatatcaatctggcgtagcaaagggaagccacgttgctgtgatgttgacaatcggaacaggaattggtggctgtatcattttagatggaaaaatctttcatggtttcagtaacagtgcgtgtgaagtaggttatatgcatctggatggcggagaatttcaggatttgggagcggccagtattttgacaaaaaaagttgccaaaagaaaacaggagtcagaatcagactggaatggatatcatatttttgagtcggcaaaacagggagacgaaacctgtattcaggcgattgatgaaatggcggatgtattgggaaagggaatttcaaatatttgttatgtactgaatccagaaattgttgtactgggaggcggaattatggcgcaggaagaatttcttggagaccgtattaagcaggcggtaaagaagtatctggtatcaagtattgaagtaaatacgacaattgcatttgcaaaacatcaaaataatgcgggaatgttaggggcgttttatcatttctgtggagtacataaaaaagaatagtgcataagaagaataggatgaagaaatgggatattatgtgaaatcagtagtgccggtaattgaatcgaattatgataagtttacgacagtagaaaaaacaatagcggatttttttattcaaaataaagagaaaagtgatttttcagtgaaggctgtttcagaacggctttttgtatcaaaggcttcgctggtgaggttcgcccagaaatgtggttatcatggctataaagaatttatttatcagtatgaagattcgttgatagaaaaacaggaatcaattaccggaaatacacgcatggtattaaatgcatatcaggaacttttgaataaaacatatagtcttgtagatgagacgcaggttggaagaattataatttatctaaaccaggcagagcgggtatttgtatgtggaaaaggaagttccggactttctgcgcgagagatggaactgcggtttatgagaattgggctgagaattgattcgctcacagatacagatatgatgagaatgcaggcggtctttcaggataaaaaaagtctggtagtaggattcagcatcagtggagagagggaagatgtgatttatttacttcgtgaagcttataaaaaaggagcaaaaacgattttgtttactgcaaaaagcaaggacagttttaagaaatactgttcggaagttgtgctgattccatctttacgacatttaaatcatggaaatgtgatttcaccgcagtttccaattttaatcattcttgatattatttatgcctattatatggaacaaaacaaacatgtaagagagggcatgcatgacagtacaattcgtgctttggaagaagcagaagagatgcatacaaaatttttggatgaagaataaaggagtaaaaaaccaatgctgattaagaatgtaaaagtctttacaaaagacaaaaaatttaaaaacggagcaattgccttatcaggtgacaaaatcaagacagtttacacagaagcaaacatgccggattcagacttggaggaaaccattgatggaaacggtgcttatgcgattccaggtttaattgatttacattttcatggatgtaagggtgatgatttctgtgatggaacaaaagaggcaattgcgagaattgcagagtatgaggcttctattggggtaactgcgattgcacctgcaactatgacacttccggtggaagaactggagcatattttagaggtggctgcagaatacaaaaaagaaaatacagacaagcgcagagctgatttacttggcattaatatggagggaccatttatcagtcctgccaaaaaaggtgcacaggatgaaagaaatattattccatgtgatgtggaagtttgcgagcggtttttaaaggcatcggatggtctggtaaaatttattggaattgcaccggaggagagcgaagaaacgattgattttatcaagtcagtaaaggggaaagtaaatgtctctcttgcgcataccaatgcagattataagacagcgaaagcagcatttgaagctggggcaaatcatgcggttcatctttataatgcaatgccgccgttttcacatcgtgcgccaggagtggtaggtgcggtctacgactgtaaacatgtaatgccggaaattatctgtgatggaatccatattcatccggcaacggttcgtgcgacattcgaaatgatgggagcagaccgtatgattttaatcagtgacagtatgcgtgcaaccggaatgccggatggtcagtatacactcggaggtttggacgtaaaggttgttggaaaactggcgactttggtatcggatggagcaattgccggctcagcaacaaatcttatggattgtatgagaacggtggtaaaagaaatgggaattccacttgaaacagctgttgcatgtgcgacaatgaatccggcgaagagccttggagtctgtgacgagtacggttccattacagagggcaaaaaagcaaatattgtgttacttgataaagatttggaattacaggcagttattaaagacgggatgaaattataatggagtttcgattagcgaaaaaacaggaatttgacagcgtcagagatttatattggatgttgattgatgagacttctcatctgccgtcttttccacactggaaaaaaggtctgcatccatcagatgagtggctgttagagagtcttgaaaaatctcagatgtttgtattagaagaaaatggggaaattcttgccagtgttatcttaaatagcaaggcaaatgaaagttatcgactggtaaactggagcagagaggttccggacgaaaaggttctgattattcatgtgcttgcggtttctccaaaacatgcaggcaaagggcttggcacaaagatgatgcagtatattttggattatgcaaaagaaatcaagatgcaggcagtacggctggacgtaatcagtaataacagttcggcggaacatttatatcagaaaatgggatttcggtttgtacagacacagaggctgtattatgaagtgactggagaaagagattttaatctgtatgaatattatttatagcggtcaactttttctgccaaaggattttgatgagccctgccgtggatgttgaagttgttttaagttttcgcataattctcttgaatttccacatactacccatacagtacaataatgggaaactaatagtatagtgaaaaatacaggaggaatgacacatgaaagcgacaggaattgtcaggcggattgatgacttaggaagagttgtagtgccaaaggaaatcagaagaactcttcggattaaggaaagtgatccactggagatttttacggaccgtgatggaaagattatcttaaagaaatattcaccaattggggaattgggagattttgcaaaagagtatgcacagagtctggcgcaggtttcgggatatacggtgtgtattgcagaccatgaccagataattgcagcaagtggaaagcgggcaaaagaatattcaggaaaattaattgatgaagaacttgaagtcgtaattttaaatcgtaaaacggtaaaacttgcgaaaaaagaagcagtcagattgacgcaaaacgatgtggcaggatatcagtcgcaggtgatttcagtaattacaagtcttggtgactgtgtcggagcagtgattattttcagcgaaaatggcgagacagaacttggcgagacagaaattaaacttgcaaaagcggcagcaggatttttaggaagacagatggagcaatagaatttcgtttgcgagattaaaaaaatggacatgacaaagcgaaaaaattgtcatgtccattctttatttcatgattttatattctattcgtttttaattgctgcctgactcatttcttcaagcaagtcacttttaattttatagagtttgtcggataaatccacatatacttcctgcggattaacgagacgcagagtttcgccccacaaggtctgtttttctttttgacagatgtcacgaatttccattacagatggggaagtatagacacattcgccttttttgaataccggaacaagcagttcacgtaaggtataagtgccaccttctatttttgtctttttccaggttgccatagggtcaaaaataatcatatctttttccgggtcaaagacttcatcggcaaggcagattaaatctgcgcggatttttccggttgctttgtcgtaaatacggaaaattgttttgtttccagggttggttactttttctacgttttcagagagtttgatttttggaatgaaatcttcatcttctttatttttgattgcagctaatttgtagacaccgccaaaagccggatgccctttagaggtaatcagatttgtaccaacaccccaggaattgacttttgcgccctgagcttttaagctgtcaatcagatattcgtcaaggtcactggaagcggagatgatagcatcttcaaatccggcttcttttaacattttatatgcctgtttggacagataagcaaggtcaccgctgtcaatacggattccatagccttttaattcaataccttctgcctgcatttctttaaagacgcggattgcatttggaacaccggatttcaagacgtcgtaagtgtcaacgagcaggatacaggcatccgggtataagttcgcataagctttaaatgcagtatattcatccggaaaactcataatccagctgtgagcgtgagttcctttgaccggaacatcaaacatctggccggttaaaacattggatgtgccgatacatccaccaatcattgcggctcttgcaccgtagattccggcatccggtccttgtgcacgacgcagaccaaattccataattccgtcaccttttgcagcatagacaacgcgggaagctttggttgcaattaaagactgatgatttaaaatatttaaaatggcagtttcaattaactgtgcttccataaccggggcaataactttaagtaaaggttctcttgggaaaataatagttccctctgggattgcatagatatcgccggtgaaatggaatcctcttaaatattccagaaaatcagtatcaaaaattttcagggattttaaataatcaatatcgtccggtgcaaaatgcaggtcacggatatattcaattacctgctccagtccggcacagattgcataaccgccatcgcacggattcttgcggtaaaatgcatcaaaaaccacgatttggtcagtgggatttttaaaatatccctgcatcatggtcaattcatataaatctgtaagtaatgttaaatttagggctctcataaattcttccttttccatacgttcttttgtgtctcaattatataacagatgaggggaataattcaaggagtttggcatagtaacacgctattttggtggaagatgaagtcctctttcataatattcttccaaagtcattccggtaagcgtaaggcttgaagcaagcccgattccggtatagcggatatgccatggctcaaatggaaaaccggtaatctcttctttgtttttaggataacgcaggatgaatccaaaaagagcacaatggcgggcaagccaacagccttctttggtttttgcaaaactttcttctaattcatagttttcatccgggcaggagatatcaagggcaagaccggtctgatgctcactgcatccaggcggagcaacaccggggcgtccatttgcagaagagaacagtgcttcctgtcttttataggagcgataaccggaaattccccataaatggatttcctctttttgggcgcgtttaaacagttcttctgcggcaatggcagcttcccgctgtaagaggcgacgtgggtcgttgcccggggcataaaaaggaatatcaggttcaattaaatcagaaggtatgtagtgagggttcagaggattttttttatttacaagaatagaaaaagaatacatgcaatgcctccatttcacaggaatagacttacatcattttatgcgaaatattcgagaaaaatcacacaaaaaaaatatttaaaaaaatttcaaaaaaagtgttgacttttttctgagtatcatatataattcattttgttgtaagacattgggctatcgccaaacggtaaggcaacggactctgactccgtcatttcaaggttcgaatccttgtagcccagctctcatatcccagacagaagtgtctgggatttttttttacagaaactaaacacttaaattagatttagatagagaaggagaatatatgaaatactcttttgacagttgtgtcagattcagtgaggtaggagaggatcagaaacttacgctcggttctgtgattaactattttcaggactgtagtacatttcagtcagagtcacttggagcaggagtcgaatttttaagaaaacagcatagagtatgggtgttgtcttcctggcaggtcgttattgaacgatatccggctttgtgtgagaaaatcaggataacaacctgggcttatggttttaagcgctttttgggaaatcgaaattttacaatggaagatgaagctggaaatgtggttgcctatgctaattccatctggacgtatttaaacacagaaacaggacttccggtggcagtttccaaagaacaggtagatgcctatggattagaagaaaaatttccgatggagtatgcaccgagaaagattgcagtaccggaaggcggaatggcatatgaactatttccggtacgttcccataacttagataccaaccatcatgtgaataatgaacagtatgtggcaatggcatgtgaatatctgccaaaagattttaaagtatggcagatgcgtgcagaatataaagggcaggctgtgcttgggaatatcatagagccgattgtttatacagatgaagaaaaatgcattgtatcactttgcaaagaaaccggagaaccgtatgcgattgtggagttaaaggagaaaaagagatgagattaggtgaaagacagaaactgattgtagtaaagaaagtagaatttggcgtctatctggctgaaagacaagatgcaggagaaaaggacagagtcctgcttccgattaaacaggttccggcaggaacaaaagagggagataaattagaagtctttttatataaagattcacaggatcgtctgattgcaaccatgcgtcagccgaaattaatgcttggagaaaccggatttttaagagtggctcaggtttcaagaatcggagcctttcttgactgggggctggaaaaagatttatttcttccatataaagagcagaccaagaaagtgcatgaaaatgaagaagtgctggtttctgtttatattgacaagagcagccgactttgtgcaaccatgaaagtatatcattatttacagacgaattctccttatacagaaggagatactgtaacgggaacggtttatgagagcagcgataactttggtgtctttattgccgttgacggaaaatattccggtatgattccaaggcaggaagcacaggggaattataaagcaggggaagaactgacctgccgtgtaacagcagtcagagaagacggaaagctgactttaagcggacgtcagaaagcacacatccagctttatgaggatgcagaaagtgtatatagtattattgaggactttgaaggggtgcttccgtttgatgacaaggcttcaccggaagtgattcaaagagaatttggtcttagcaaaaatgcgttcaaacgtgcagttggacatcttttaaaagagaaaaaaatagcaataaaagacggaaaaatttatcttctttaacgcttcacgaatgaaatcaaatatgttataataagcccgaaaatatcccatgtaggggagactacgaatactatgtttgtcattgtccaagaaggaggaaaataagtggactcgattgattattatgaccgatacgcggtaccttattatgaagaaactgttaatttaagcatggaggagcagttacaaagttttatggaattgctgccggaaaacggggaagtgcttgatttaggctgcgggtcgggaagagacaccttgtttctcgaggaagaaggtttcagtgttacggccatggatggttcaaagagaatgtgtgaactcgccgaaattcatacaggaagggatgttctgcatcttcgtgtagaggatatggaatttgatgatgtattccatggaatctgggcatgttccgtgctgggacactttgcgccaaataaaattcatgaagtgctggggaaaattctggatgccctgaaagatgatggaattctttatttttcggtgcgtaagggcgaaagaaagggaatgtacagcgggcgttattactgtgattatgacagagattccctggatgaccttttagattcttttgataatattgaaatcattgatatatggaaaacaagtgatgcaagaggagacgaacaaagtaagtggtacaatgtgcttcttagaaaaatcagtaaagagaaagaataaaaacgtgtagttagttgatgtactctcgaaatcaagtacaaaaagatttcaagagcacatagttggaaaaaaggagaatgacagtgaattttactcatttgcatgtacatacagagtacagcctgttagacggttccaacaagataaatgaatatgtgtccagagtaaaagaactgggaatgaaaagtgcagccataactgaccatggggtcatgtttggttgcattgatttttataaggcggcaaaagctgccggcattaaaccaatccttggatgtgaggtttatgttgctcctggttcacgctttgacaaagaaaaaggaaaagaagaggaccgttattatcatctggtgctgcttgcggaaacgcaggagggatatcagaatctgattaaaattgtatcttacgggtttgtggatggattttattataaaccgcgtgtggatatggaattgttagaacaatatcatgaaggaattattgcattaagtgcctgccttgcaggagaggttgcaagaaatcttgcaagaggattttacgaagaaggaaaggaagcagcactcagatacgaaaaaattttcggaaagggaaatttctttctggagctgcaggatcatggaattccggaacagaggcaggtcaatcatgaattgattcgaatgagtcgtgaaaccggaattgaactggtggcaacaaatgacgttcattatacctacagttccgatgctgaggcgcatgatattctgctttgtgtacagaccggaaaatcgttaaaagatgaaaatcgtatgaggtatgagggtggacagtattatgtcaaatcagaagaagagatgagacgattgtttccttatgcacccgaagcgattgagaataccggaaaaattgcagagcgatgcaatgtggaaattgaatttggtgtgacgaaacttccaaaattcgatgtgccggatggatatactgcatgggagtatttgaacaaattgtgctttgaggggcttgataagcgttataccgataataaggaagaactcaaaaagcgtctgaattatgaacttggtgtcatcaaagacatgggttatgtagattactttttgattgtgtgggatttcatccgttatgcacgggaacaaggaatcatggtaggaccagggcgaggctcggcagcgggaagtctggtttcttatacacttggaatcacgaagcttgacccgattaaatatgatttgctgttcgaacgttttttgaatccggagcgagtgtccatgccggatatcgatgtggatttctgttttgaacgacgccaggaagtcattgactatgtggttgaaaagtatggaaaagaccaggtagttcagattgttacttttggtacgatggcggcaagaggtgttatcaaagacgttggaagagttatggatgttccttatgtgcagtgtgatacgattgcgaaaatgattccgcaggaactaaatattacgattgataaagcaatgaaggcaaatccggaattaaagaaaatttatgagacggatgagacggttcgcaaactcattgacatgagccggaggctggagggactgccgaggcatacctccatgcatgcagccggtgtcgtaatcagccagaaaccggttatggaatatgttccattatcaagaggttcagatggttcgctggttacgcagtttacaatgacaacactcgaagaacttggtttgcttaaaatggattttcttgggcttcgtacgttgacagtgattcaaaatgcagaaaaactggttcggcgggataaaggaattgagcttgatatggacaagatcgactacgaagataaaaaagtctatggaatgcttggagcaggaaaaacagaaggggtgttccagttagaaagcacaggtatgaaaaacttcatgaaagagttaaaacctggaaatcttgaagatattattgcgggattgtcgttataccgtccgggaccgatggatttcattccacagtatattaagggaaaaaataatccggatgaaatccactatgactgccctgaattagagccgattttaaaggcaacatacgggtgtatcgtttatcaggaacaggttatgcaaatcgtacgttcacttggaggatatacccttgggcgaagtgatttggtgcgtcgtgccatgagtaagaagaaagcatccgtcatggaaaaagaacgccagaatttcgtgtacggaaacgaagaagagggagttccggggtgtattcatcgtggaatcagtgaaaaaacagcaaataaaatttacgatgacatgattgattttgccaagtatgcgtttaacaagtcacatgctgcggcttatgcagtggtttcttaccagactgcattcttaaaatattattatccggtagaatatatggctgcgcttatgacttccgtgattcataatccgtctaaagttgcagagtatattttatcaagcagaaaaatgcagattgaaattctgcctccggatattaattttggagagagtgaattttcagcagaccatggagcaatccgctatgggttatccgcaatcaagagtctcggagcaccgatgattcgtgcgattgtggaagaaagaaaagaaaatggaaaatatcagtcacttcgggattttattgagcggatgagtggaaaagaactgaataaaagagcaattgaaaatctgattaaagcaggagcacttgaccaggttgcaggaaaccgtcgtcaaaagctgatggtctatgcggaaattgtggatgcagttaatcaggaaaagaaaaatgcaatgaccggtcagatgagtctgtttgatttgatttcggatgaagaaaaagaagcttatgagattcagatgccaaaagttgaggaatattccaaagaagaactgctttcctttgaaaaagaagtgcttggtgtgtatataagcggtcatcctctggaagaatatgaagagagatggagaaaaaatattacagcacggacagttgattttcagatagacgaagaattgggaacttcaaaagcaggagatggagaaatagcagtcataggcggaattatcacaaataagactgtaaagtatacaagaaacaataaagtgatggcatttcttaccattgaagatttggtgggaacggtggaagtcgttgtttttccgaatgattatgaaaaaaatgttcaaaagatggaggaagattccaaagtatttatccgaggaaaagttcagggtgatgcagataaggcaagtaaattaatttgtgaaaaaatttattcgtttgacgatgtaccaaaagaactctgggttcagtttgagacaaaagagaactatcttacagaggaaaatgagttcctgaaacttctgtcaggttctcgcggaacagaccgagttattatttatgtacgcactccaaaatcgattaaatatttaggaattgaaaaatccgtgaaaattaacgaaacactgttgggtaagttgtacgaaaaatacggcatggacaacgtgaaagttgtagaaaagagtattgaaaatattacaaaaatgcattaaaattaagtacgattagaggtcaaagaggaaacgtatatattaatactttatggaggaagaaaatgactgcaaaaaaagaaattaagacaatcggtgttttaaccagcggtggagatgctccaggaatgaatgctgcaattcgtgcagtagtaagaagaggattaagtaaaggaatcaagatgaaaggtatcctgaaaggatacaatggtttattaaatgaagaaatcattgatatgactgctgttgatgtatctgataccattcagaaaggtggtacaatcctttatacagcacgttgtgcagaatttcgtacagaagaaggacagaaaagaggtgcggaaatttgcaaaaaacacggcattgacgggcttgtagtcattggcggtgacggttcttttgcaggtgcacagaaactggcaaacttaggaatcaacaccgttggtgttcctggaacaattgacctggatattgcatgtactgagtacacaattggttttgatacagctgttaatacagcaatggaagcaattgataaagtacgtgatacatcaacatcacatgagcgtgtaagtattatcgaagtaatgggaagaaatgccggatatatcgcattatggtgtggcattgctaacggtgcagaagatattctgcttccggaaaaatatgattatgatgaacagaagattatcaacaacattattgaaaatcgtaaaaaaggtaaaaaacatcatatcatcatcaatgcagaaggtatcggccattcacaggctatggcaaaacgtattgaagctgcaactggtattgaaacaagagcaaccattcttggtcacatgcagcgtggtggaagcccgacttgtaaagaccgtgtatatgcatctacaatgggcgcattagcagtagacgttctgcttgaaggaaaaacaaaacgagtaatcggttataaaaatggtgaatatgttgattttgatatcaatgaagctctggcaatgcagaaatccattccggaatatcagtatgaaatcagctattctctgtcacataactacagcaaaaatgactaattaataaaaagtataaaatataaaatgaggctgttgcactgatatacacagcctcgtttttaatttagttatggagaaaataaaatgataacaagtatgtcaaatggacagatgaagctggtgcagcagttgataaaaaaagcgaaagcccgtaaagaatctggtctttttgtcgttgaaggaatgaaaatgtttcgggaagcaccacaggagagaattgaaaaagtgtatgcttcctcttcttttctgaaagaagcagaaaatcagagtgtaattctggaaaaaggctgcacagaaaagaatggaaaattagaagaggtagatgacaaagtatttaaaaatctgtcagatacagtgactccgcagggaattttgtgtttgattaaaagggtggaaactccgatcaaagaaattttaaaaacaaaagatgaaaaagccccatttcttatgattctggaagacttgcaggatcccggaaatatgggaacaattcttagaacagcagaaggcgcaggggtaacaggaattattttgagtaaaaattgcgtggatttatataatccaaaagtaatccgttctacaatgggttccatttaccggatgcctgtgatgcaggcagatttgcttgaaattcttccggttttaaaagaaaataaaatacagacttatgcagcacatttaaaaggaaaaaactggtaccatgaggaagactatacagagggaactgcatttttcattggaaatgagggaaatggtctaagcgatgaattatcagattcagcggactgtctgattaaaattccgatggaaggaaaagtggaatccttaaatgcggcgatggcagcaggaatcctgatgtatgagactgcgaggcagagaagaaccggtagataagtctaccggttatcaattttttctggatataaatcatgctgtgtcaatctctggaaagcaacctgttcccataaagtgccggcttttccatagttgcagtaagggtcaatggaaattcctccacgtggagtgaactttccccacacttcaatgtatttcgggtccatgagccgaatcaaatctttcataataatattcatacaatcttcgtgaaaatccccatgatttcggaaactatataaatacaatttcaaagatttactttctaccatacgttctcccggaacataagaaatgtaaatcgtagcaaaatccggctgaccggtaatcgggcataagctggtaaattccggacaattgaattttacaaaataatcattttccggatgtttgtttgggaaggtttctaacacttctggtgcataatcatctttataaacagtttttttgtttccgagcaggcttaaagttccaagctcgtcttttgttcttgtactcatatcaacgacaatctcctttatataaaatgtatcagttacctcaattaggaaataataaaagtatatcaaaatgcagtacctcttacaagagaaccttagaaaaatgtaaaaatttacaaaatattacaaaaaacaccgtattgacattgaaaagtaatcttgatacaataactttgtaataaaaattaataaatttgtaataaattcaagcaaagtaatcataaggcttgataaaacgcagaaatttcaggaggtaattatgaaagaaagaatgcgccatattttatgttgtataggaacggttggtttgatgatgacaatgggggcagtgcctgccatggcagatactttagatgatgcatcttataactgggacgataaggtggctgcgaatgtagttacatacgctaatattcgcgaaagtgcagatgcagatagtagctgcgttggacggcttccatcgggagcggttgcaaccgtagtcggaacggaaaatggctgggtagagatttgttccggagaagtagagggatatattcgtgaggatttactgttatatcaggacgatgcaaagaatttatacgaagcactgcatggaacaggcgatgttgttacggcagaggcggtaacacaggaagagattcaggaaacagaggaaattcaggaagaaattcaggaaacggcagcagtagagacagatgcttctgcttcaaaccaagatttggatttgatggctgcaattattgaatgtgaagcaggtggggaatcttatgaaggaaaaatcggagttggagcagttattttaaatcgaatcagaagcagtgaatttccaaataccctttcagaagtaatttatcagagtgggcaatttgagccggtctggacaggaaaattagcaagtgtactttcaagaggagcaaatgcagactgctatgcggcagcccgtgatgtctttgcaggagcaaatacaattggtgaatgtctcttcttccatgcgggtggtggaagtggacttactattggaaatcagacattttattaaactttgttaagaattaatacaaaactaatatacaagttgttagaatcagtcttttacgatataatatcctaaagggctgattttttatttcatagaaaattttgttctatgaaataggcaaaataaacaagaaaggaatgtgaggaagatggcaatactatcagcaggcatgatttctcttggttggctgatactgcttgggattctcctaatcattgagattatcacgctggggcttacgactatatggtttgcaggaggagcattaattgcatttcttgtggcgattttaggcggtgcagtctggcttcaggttgtggtatttctggcagtatcaattttgcttttgctgtttaccagaccaattgcaatgaagtacatgaacaaaaatgtacagaaaaccaatgtggacagtctgaaaggggaaaaagcagtggtcattcaaaccatagataacttaaaaggaacaggacaggttgtcatccgtggaatggaatggtctgcaaaagcaagagaagataagattataaaagaaggaactgtagtaaaagtcattactgtagaaggcgtaaaagccgtagttgaggaggaaaaataatatgccgattattttattagcagtcattattttactggcacttatggttgcagcatcctgtgtaagaattgttccgcaggcgcatgcaatgattattgaacgactgggaatgtataaagagacctggtccaccggtcttcattttaaactgccattttttgaccggattgcaaagagagtgaatttaaaagaacaggtagtggattttgcaccacagccggttatcacaaaggataatgttacaatgcggattgatacggttgtgtttttccagattacagacccgagactgtttgcttatggagtggaaaatccgattatggcgattgaaaacctgacggctacaacgcttcgtaacattatcggtgatatggaactggatgcaacgctgacttcaagagaaattattaataccaagatgagagcatctcttgatgtggcaaccgacccgtggggaattaaagtaaaccgtgtggaattaaaaaacattattccgccgtctgcaattcaggaagcaatggagaaacagatgaaagcggaacgtgaacgtcgtgaagcaattctgattgcagaaggacagaaaaaatctacgattctggtagcagaaggtaaaaaagcatctgcaatattggatgcagaagcagaaaaacaggctgcaatcttacgtgcagaagcagaaaaagaaaaaatgataaaagaagcagaaggtaaagcagaggcaattttaaaagtacagcaggcaactgccgatggtatccgctttatcaaagaagcaggagcagatgaaagtgtattgaccttaaagagtctcgaagcgtttggaaaagcagcagacggaaaggcaacgaagattattattccatctgagattcagggcattgcaggacttgcagcttctttaaaagaaattgtaacagatgacaaaaagcaggaaaaataaaattcaacttaaatagtgtttgagtaaaatcaaaaatagaaagattcaagtgcgtgcaggcgtacttgaatcttttggatttatttaaccaaatcaagtaagttccctgcttcaattgcgaaaagcaataagcaggggtggggacttgcttgtatcaggaggggggggcaagccccttctgataaactgcgtagcagctatttggttatgagcaagtagcgaagcggattgcgaatatccacttgacattttcgactaacaaagggcaggtgatttgtaatatgaaaccagtaatcgatttagagaaagaatacggtcttgtattagaaggtggaggcgcaaagggggcataccagattggtgcgtggagagccttaaaagaagccggtgtgaagataaaaggtgtagccggaaccagtgtaggtgcattaaatggtgcacttatctgtatggatgactatgaaaatgcaaagaaagtctgggaaaatatcacatattcaaaaatcatgtcagttaaagatgaacaaatgcagaaactgtttcgcgaaaagaaagcggatataacgatgttgaaggatgcttttaatctgatgaaagaaggcggaatcgatgtgactccgcttcgggaattaattgcagaatgtattgacgaggaaaaaattttaaactctccgattgacttatatgtactcacatttgatgtggatgaatggaaagaactggatattaatatgaaagagtgtgaagatccatcgatgataaaagattttttgcttgcaagtgcctatatttttccattatttaaaaatgaaaaattacatggaaaaacttatattgacggaggggcaattaataatgtaccgcttggctcccttgtggaacgtggttataaagatattatcatgatacggatttttggtgtaggaagagaaaagaaagtaaagataccggaagatacaaatatttatacggtagcaccaaaagtcagccttggaagtattattgaatttgactcaagaaaaaccagaacacatttaaaacttggatattatgatactctgcgtatgatttatggattgaaaggaaaaatttattatattgatgaatcggaagaagagtgttattatttaaatcagctagtaaagcttaatgcagagaattatcggcacatcatgacggcatataaactgtcgcaggctgaaagccggtattgccgaaatatgacagaggttgtactgccggttatagcagaggaactgaaactttcaaaggattggacctataaagaactctatcttgcggttcttgaggcaactgcgaaattatgcagaatcagtaagtataaagtatatacggtagatgaactgcgagaaaagatacaggaaaaactgcatgggctttcaggccgtgaattgcctgcatttgtatggattgttgcaaaagaaattccagaagagatatccagcacagatgaataaaaaggatgagaaataaagaaatcggaggataagaacatggatttaaaaggacgtaattttttaactttaaaagatttcacaaaagaggaaattgaatattttattaatttagcagcagattataaagaaaagaaaaaacagggtgttgcagtcgataccttaaaaggaaaaaacgttgctctgatttttgaaaaaacaagtacaagaacacgttgttcttttgaagtggcagcacatgatctgggaatgggaactacttacctggatccgaaaggttcccagattggaaagaaagaaagcattcgtgacaccgcaagagtacttggaagaatttatgatggaatcgaatatcgtggatttggtcaggaaatcgtggaagaacttgcaaaatatgcaggtgtaccggtatggaatggtctgacaaatgaatatcatccaactcagatgttagcagacttgttaacaattcgcgaacaccttggaagagtagaaggtgtgaaattagtatacatgggtgatgcccgttataacatgggaaattctctgatgattctgtgtgcaaaaatgggcatgaactttgttgcatgtgcaccgaaaaaatacttcccgaatgaggcactggtaaaagaatgtgaagcatttgcaaaagaatccggtgcgaccattactctgacagaagatgtaaaagaaggaacaaaaggtgcggatgttatttatacagacgtatgggtatctatgggagagccggacgaagtatgggaagaacgtattaaagaattatctccatataaagtgacaaaagaagtaatggaaaatgcaggaagtcaggcaattttccttcactgcctgccggcattccatgatctggaaacaacgatcggtaaagagatgggagaacgctttggcatcaaagatatggaagtaacagatgaggtatttgaatctgaacagtctgttgtctttgatgaagcagaaaaccgtatgcatacaattaaagcagtgatggcagctactttaggagcataaaaaatggaattaaaagcaaaatggatggggattccatggaactggacagaagaaatggattccacaaatgaatgggcgaagagggacgcaaaaaatggcgctccctctggcgctgtttatatagcagacagccagacacagggaaaaggcagaatcggaagaagatgggagacgccaaagggaagcagtcttgcgctgtctcttttactgcgccctgattttgaagcagaacatgcaccgatgctgactttagttatgggaatggcagcgtgcatggcaattgagaaaattaccggtcttacagccgagattaaatggccaaatgatgtggtaattaataagaaaaagacaaccggaattttgacagaaatgggaatgtctgagggaaaaatttcttatgtggtagttgggattggaatcaacttaaatatggaatcctttccggaagagcttgcgtataaagcaacgtcattaaagatagagtgcggacacgaaatcaacagagatgaaatagcggctgcgcttttattttattttgaacagtattatgaaaaatttgaacagactcataatcttggatttttaatagaagaatacaacaatcatctggtgaaccgcggaaaagaagtcctgattaaagaagaagatggagaatacacgggaatcagtcgtggaattaatgacaaaggagaacttctggttgagaaaaaagatggaaactgtgtggaaatcttttcaggagaagtttccgtccgtggtttgtatggatatgtgtaatgaattgtaagttggaaaataaattggaatcagggaatgagtcaggaaaggaaagcaacaaagagtatgtataaagataaaattgtgctgtgcggggcaagtgcttatgaacagaaatattattttaatgaagattttaaggcacttccacaatccgttcaggatgaactgcatattatgtgtgtcatgtataccacagaaatcggaggtgtgctgactcttgaatttgatgaagagggagagctgcagtttcgtgtagaagcactggaagccgatgccatgtttgatgaaatcggaagtgcgcttcggattaaacagatccgaaaagaaaaacaggaattattagaagcattggaactttactatcgtgtattctttcttggagaagatgtttctctggacgaggaatagagagtccaatttattggggcaagatagaatggtttaaagggcaatggcatataatattttgaaaaacagaggttaacagtgaagctgagtattggaaatgtaacacttgaaaataatttaatactcgcacctatggcaggagtaacagacctgccatttcgtttgctttgcaaagaacagggagcgggacttttatgcacagaaatggtaagtgcaaaagccattcattttaaaaataaaaatacagaaagtctgatgcggattttacccgaagagcgtccggtgtcgcttcagttattcggctcagatgcggatttgatggcagaaatcgcagcacagattgaagaacgtccatttgatattttagatattaatatgggatgtccggtgccaaaagtagtaaacaatcaggaaggttcagcactgatgaaaaatccaaaattggtgggtgagattgtaagcaaggtttcaaaagcaatcaaaaagccattgaccgttaagataagaaaaggatttacagaaaaaagtgtcaatgccgtagagattgcaaagattgtggaagatgcaggagcttctgcaattgcagttcatggaagaaccagagaacagtattatgcaggagtagcagactgggaaattatccgacaggtaaaagaggcagtttctattccggtcattggaaatggagatgtcgattcaccggaacgtgcaaaggcattagttgaacagaccggatgcgatgggattatgattggacgggcttcaagaggaaatccctggattttttcaagaattcagacctatcttgaaaccggagagataccgccacagccgagtgcagaagaagtaagagaaatgattttaagacatgccagacttcagattgaatataaaggagaatataccggtatgcgtgaaatgcgaaaacacgttgcatggtatacagctggtatgcctcattcggcggcagtaagaagagaagtcaatgaagtagagacgtatgagcagttagagcggctggttaaagacagattggaatcttgacatttttactcatttcatttataatattgggactgttgagaagattatgacaaaattttaaattcattataaaatcaaaaataactgagaaaggatgttttatcatggaagcaaagaaaaacatactgacctatgcaggtcttaaaaaactggaagaagaactgcatgatttaaaggtaaataaaagaaaagaaatcgctggaaaaattaaagaagccagagagcagggtgacttatccgagaatgcggaatatgatgcagcaaaagatgaacagcgtgatattgaagcacgtatcgaagaaatcgaaaaaatcttaaaaaatgcagaagttgtagtagaagatgaagttgacttagacactatcagcgttggatgtaaggtaaaagtttatgatgtagaatttgatgaagaaatcgaattcaaaatcgtaggttctactgaagcaaatagccttgaaggaaaaatttccaacgaagcgccggtaggaaaagcattaatcggagcaaaaaaaggtgataccgtacaagttgaaatgccatccggaattatcgagtacaaagttctggagattgaaagaaatatctaaagattaaggagagtgtgaagaagtggcagaacagaataagaacgcacaggaacaggacctgaacaagctgttaaaggttcgtcgcgaaaaattagcagaattgcaggaaaacgggaaagacccgtttcagattgtaaaatatgatgcaactcatcatagccaggaaattaaagatgcatttgatgaattagaaggaaaatctgtatccgtagcaggacgtattatgtccaaacgtgttatgggtaaagcttctttttgcaatattcaggatttaaaaggaaatatccagtcttatgttgcaagagacaacattggtgaagaatcttataaagattttaaaaagatggatatcggtgatatcgttggaattaaaggtgaagttttcaaaacaaaaaccggagaaatttcaattcatgccactgcagtcacactgctttccaagagtcttcaggtacttccggagaaattccacggactgactaacacagacctgcgttaccgtcagagatatgtggatttaattatgaatccggaagtaaaagatacttttgtaaaacgttctaaaatcatcagcacaatccgcagatacttagatggacagggatttatggaagtagaaacacctatgcttgtagcaaatgccggtggtgctgctgcaagaccatttatcacacattctaatgcacttggagaagacttcaaactgcgtatttctcttgaattatacttaaagagactgattgtaggtggtctggaacgagtatatgaaatcggacgtgtattccgtaacgaaggtgttgatacccgccataatccggaatttacactgatggagttatatcaggcatatacagattacaacggaatgatggatttaacagaaaatctgtatcgttatgttgcacaggaagtacttggaacaactaaaattgtatacaatggcgtagaaatggacctcggaaagcctttcgagagaattaccatgttagatgctgttaagaaatattcaggtgttgactttaacgaaattcatacacaggaagaagcaagagcagcagcagacgcacatcatgtagaatacgaagaaagacataaaaaaggtgatatcttaaacctgttctttgaagaatttgtagaagaacatctgattcagccgacattcgttatggatcatccaatcgaaatctctccgttgacaaagaaaaaaccagagaatccagattatgtagaacgttttgaattcttcatgaacggatgggaaatggcaaatgcttactctgaattaaatgacccgattgaccagagagaacgtttcaaagctcaggaagaactgctggcacagggcgatgatgaagccaacacaacagatgaagactttatgaatgcgctggaaatcggtatgcctccgacaggtggtatcggatttggtattgaccgtatgtgcatgattctgacagactctgcagcgattcgtgacgtattattattcccaacaatgaagtcacagggtgctgctaagaacgaagcaaacaatgcagcacaggaaacaaagccagttgagaagattgatttttccaaagtaaaagttgagccattattcgaagaaatggttgattttgatactttcagcaagtcagatttcagagctgtaaaggtaaaagcatgtgaagcagttaagaaatccaagaagctgttacagttcactctggacgatggaacaggcacagatcgtaccattttaagcggtattcacgcttattatgagccagaagaactggttggaaaaacactgatcgctatcacaaacctgccgccaagagctatgatgggaattgattcctgtggaatgttacttagtgcaatccatgaggaagagggcgaagaaaaacttcatcttctgatggttgatgacagaatcccagcaggtgcaaagctctattaagatgagaaaactgagccttgcggcggtgtgcgcttgcgaacaccgacataaggcgaaaaacacacggagacgtcagtcgacgtgatgtaaagatgtaccgttttaccaaataaacgggacgtacttcatttgataaaaaactaaaaaaacagcgatttacatcaaacttacattaattgatgcagaaatcggtgcaagcaagaaaaaatcgcataattagtgcaatgagtgggcaattccaatcggagttgcccatttttaaaacaaacagaaatacaaatcgggatttaacgcttgagaaaagaggagtaaacatggcaaagaaagaagaaagatttgaagttacatttagagacggaagtgggcttaaagatgaaggaattcgtcaaattcttgtagataaggagactggggttaactacctttgttggaactccggatttggagccagtattacacctcttctggattcggaaggaaaagtcatagtcacaaagtaaaattcttgtttgaaaaattgagaaaacgtaatattgaacaaaaaagaaatgcacagttcttagcttattgtgaactgtgcatttttgtaaataaatacttttaattagccgattacggcatcctctgctgtaaaatgttccagagaattttcttttacctgaatgcagatataagtaattccagaaatatcggatgcaaaaaactgacgctttgcagcaggtgcgatttttagccagtctccagttgaaaggctaatttcttctccatcaattatggctctgccgttacctgaaagaattccatagatttcttcattttctttatgagaatgaacaaatggaacatttgctcctgcaggtagttcgtttaaactgatttctgcacctgttaaagacaacttttcatgtagctcaattcggttttcctttccaatagttgtttttgtgtaatttgccataatagtacctccatagttaatttgtagtttctggttgcttggtattagtatagtgtgagacacatacaaaaacaagtacgcacctttttgtaactgtacactcaaaaatgaatgtgttacaatagactcggaggtgagaattatgcgagcaaaagaagaattaccggaatgcccagttgcaacagcagtatctcttatcggaggaaaatggaaactgctgattttgcgtaacttgaaagagcgtccatggagattcaatgagctacaacgaagtatagatggtatttcacaaaaggttttgacagatagtttaagacaaatgatgagtgatgggctagcatatcgccacgattaccatgagcagccaccgagagttgaatacggcttaacggaactcggaacaaaaatgcttccaattgttaattcacttgctgactttggtaactactataaatcaattattgatgttgtatcataaaagttgacaccacattctcaaggattttgatataatcataatcaatacgagaacaggagaaaaacattatggcacgaaatcaaagaacctatgacaacgaatacaaagcacaggcagttaagcttgctcaggaaatgggtggagctaaagcagctaaagaactgggcataccagatggcacgatttactgctgggtaaaagcatttaaagaaggacgccttagcgcttcagaagcatcccatactcctaaaaatgctttatcacttaatgatgagcttatcgagctcagaaaacgtgtgaaagagcaggataaggaaatccgccgtttaaaggaagaaaatgaatttcttgaggaagcaagtgcttttttcgcagccagccgtcggaagtcagcaaaaaacagagagtaatgtttattgcaagcaaaacggatgacggcaggatcaagggtaaaatttctttttattgcagagcacttcatgtttccagacaggcattcaataaatatctaaaaacaaaagcgactccttggaaatatcagccgttggcagatgcgatggttgctatttgccgcgaagatgaatgcaatgatacatatggaaggatccgtatgtatcaggcgttacagctcaaatagccagaaggagtagacattcctagtgagagaacggtttatcgtgtcatggaagaaattggtcttactcataaaccgaagcgtaagccgaacggtattactaaagcggataaaggagctcggaaatcagatgatttaattaagcgggacttttcagctgagagacctctcgaaaagtgtattacagatatgactgaaataaaggcttccgatggaaaactgtatgtttcagctatctttgactgctacgatttagcagtattaggtctggctatggatacgaatatgaaagctgccctttgtgaacaaaccttagataatgcctataaagcatatccgatgctccggggtgccattcttcacagcgacagaggtacacagtatactagcgagttgtaccgtaacgcaatcaataaatatggcattcttcaaagtatgaacagtgccggtggcagatgccatgacaatgcaagatgtgaaagtatgtgggcacgattcaaagaagaattactttatggacgctacgacgccaccttgatgactgtagaacagttaaaaactcttatttggagatattttatcagttattggaataatcggaggatctgctctgctaatggtggactacctccgatggttaagcggcaacaatactatacttcactacaagaggcagcataaggtcgaacatccttgtgaaaaaagtgtaaaccaatattgacaatatcattaatattgcactacctgtaaaggagtatagagaggatggattggataaaaaattaacagaaaaaattactgtttcagatatagggtatcttgatgtaaattgtgattttaggaagtacaagggtatattagaaaaaataaaagagtatatcaatagtattcaaatatttatgaatcaagtgcctttttatggcgattatatgatggaactgatagatgtttgtaactgtgtaatcaaaacatataatgcgcttatggaaggtaattaccagaatagtgaacttgtttttagttatttggaattgctctatgaccatgcaagtttactatatgcaaatcgtgatttgaagattcaggagtgtattgatagaacagaagaacgccataggcaagccatagatgaagataaaataaaagaacagtttgaggaatttcattaattaatggatcaaatactacataagcatgaggcgttccattttgattttgaaaatcagggaaattatgaaaatatataatttggtttccgatgggtgggagcctataagatttctgcagatgaattgttagatggaaaagaaggaaaagcaacagaaacaaagctggagagagggataaagctgatccgggaacttcttgctgataaaaaagaaatttcaatccgggaattagatgaaaaagcaaaggaacaaggaatttctggaagaaccatgcgtgatgtaagaaaccggatgaagaatgagttggagtatcaagtaaatgaaaagcaggaaaacagtattcggttaaaagaatgatgggtggcagagtcattgaagcaaatataaattttttcggagatgttaagcagcatatagaaggtgaaaaaggtatagatgattggaaaatgctctctgatattgcaagctttaaaaaggaatatatgcaagaaaattatcgtaatgctagacagattacagcatactgcaataaacgatttaagcttaatatgtgtgcaatcaatttggatgggactggagttcatgaaattacaagtgcgagcgcttttgaagaggcgttttctggaattttccaaaaacctcagaatgttggtttgagttgtattattgttaagaatccatcagaagcagatgaactactggcaaagtatgaaatgtatatatctaggattcatgatataacaaaagaatcggtcgaattacagagaacaaaatagaatctgatgatggtcgaacaatctaaaggtcttgaattcgaaactgtatttgcagttaccggtcgaatgagcgaaaatgaaaagtacattacctatacaagagctttgaacgaattgtatgtgtatgatgaagagataaaacttagcgtgatttctataaaaactggaactaatgagaaagctgacaagaaaactaaagaaaaaagtagccgtaagaagcgagaaaagagaagttctaaggaaacagctgatgctgatttagagctataaatataatgaatctgaaatcaaaatgtgtaggaactatatttttaggcatgaaaatggaaacggaggcagtgaaatagatatatcaaaagtagactggaaactttatcgtgaacgtgtctcagactggcaagaacattatatggaaaaactaacagaagaatatgtaaaattactaacttctcccggcaacgcatcagatcatttctgggaactggaaaaaagaattaagcgggacaagaaacatcccgggattttaattgagcttcgcaaatctactgctatatgggatattgcatattttgtaagggataaggtgattacaatggatgaactggaaggattcagtgaggacttgattgatgcagtaaagttgattttaagtaggtaattgttaaacggataataaagttgaaaagggatggtatgaatatgagggatgctataacactaaattattataatagcaatgctgctgttttttctgaagctacaaagaatgtagatttttcggaagttcagcaaatattcataaagcatctctccacggatgcttctattttggattttggttgtggatccggacgtgatacgaagtattttctggatcagggctatcatgtaaccgaaacagatggctcagaagagatatgtaaaatggcgactgagtatacaggcatccaagtaaaacagatactgtttgaagagtttgcaaggcagatttctggactacagatagaaaaaatgtggattaccggagctgtgagagaaggaagaggtgacgagaggtggttggatatattgcttcgcaaggcagacatttgctgaatattgaggcaaaatattataataaactggatatcgaggctttctctcagatgatgaaagatccctcttattgctacaagttttattggttggaggccgtggtacatatcgtttcaggaggaaagaatgagacaacatttgatgagattattgatgaaatgattgcgaatgcctggtattcagtacgggaatttcatattcaccttagtggaatacaggcagatggattggtcagagatggtctggaaagggcaattttacagctgacagaactcagtgatcttccggcaaatgcatctaagatcgaaataaagaatgctattcggaaacatcagacagatttaaagaaagtaaaagaacagttgactaatatggtgccatatagagcactggcaggcttttttacaaagagtaatgaagtaccggactggggaagtgtcaaacgcattacggcgtacattcaaaaggtaaatgaactggtaacacctttgccatatgtattgggtgaaagcagtaaattaaaaaaagaggtgcattttcatccagactgggcagcaatgatccaggacaatacagtcaatattcttggctggattcaatatgaaaaagtgaaatggcttcaaaataataaccctgaagtgcctggtttgatttataagcttactccagtggatgaaaaaatgcgaaagctgtcaaatgtgcggaagttgtggcagggaattatggaagtacaggaaataagggatgttttcacaggacagttagtaaaagaaaaacagtatgatatagatcatttcattccatggtcttttgtaatgaatgatgagttgtggaatctgatgccgatggattcttccttgaattcctcaaaaagcaatcgattacccaagtggaatccattttttgaagttttttctggaaaccagtatctgatgtatgaaatgataaatgaaaaaccagaacttcataaacgatttgaagcatgttatcgggataatctgcattctatctgggctggtcaggaattgtaccgtaaaggtaattccagagaagtattttataacattctggaaaagaatatgatgccgatatatgattcggccagaagacaaggatatgagatctggaactatgggtagaaggagagcacaatacaatgaaattattgggcttatctcggaaagaaaaagaaacttgaacctccattgtaatccaaggaattaagccgaatatgcaggttgatgacgttcttttgaagaatgctacagaaagtcatattagccagcatattcgaattttggaagaaagtgttcgtcttgtgttagaatctaaaaataaaaaaacaagagaagataggtatgagttggtattacaacattttagcgcattgtcaaaaatccggaagtatgccgataaaaatcagaaaaaaagaattgcggatgcacaggattatttcatgattatgaatgaacactataaacatccagaacgtatcagaaagcaggaaaagcaaaaattgaaaagacagaaacgagattcgttttatgaaacatggaatcatcaggattctttgcctgtttatattgcaggaagttatgattttcacacagcatatattggaaacagacgctgtataatgtttgctccaacagaagaacttgacacacttccggcattgaaaaaacaaattgcaaaaatacagcaaattgataatgtgccagttgtatttgaacttgcgacagtatctaattatcgaagaaaaagccttatagaaaataatataccgtttattactgataagcaggtctttcttccttttattgggacaatgctttttgatgaaaaagacccacaaaagctgacgggtaagtttgtttactccacgcagcagttgtttttattttatactacgattttacaatcacagtcaaaggagtgggggtacaggctttcattaagagaaaaaaagaagaagtattttgtttacgaatatctgtttgaagagaatcctatattaagcgtgaaacggtttgatgctttgagcgaagaatggctggaatttattaaagacaaccgaagtaaaggcggattacaacacaactatgatgtagtaattggaccggttgcagatgataatacaatggagactgttcaactatatatagcgaatattttgacagcatcagaagcagtggaaagattacggtataataaagtaaataatcaggtatcatttcacacagagaaagcgttacagtatttacagttggtaaggaggacttcttatgccagaaatgatttatagttttaatggaaaagatatcactatgaatgtatgcatacaaattagagatgtattaaaattattgcaacaacattatcaaatcagtttcgaggaagcagcattgaaattttataaatccgaaacgtataagacattgcaggaaacagaaaatggattatgggcagaatcggcagaatatatagctgacaggtattatgaagaagccgaaagtaatccagttgccgtttaaggagtggttgatatgtgcaagacgatgcaggtacgagaggctattacacaaaaataagaaaatcagttttgtaccaatcatgtaccaatctgtaaaaaatatcgtagagatataaaaaataagacctattgtggagccattatccacgataggtctttcatattcgagccattaaaaattttttctacatttttttatgtatgtctgaatcagggtgaagcatatgcaccggaagaaatacggagaaagtctgtctgtataaatgaagatatcggagaaattctgaaggaactgtagacttgacagacagattcgatcgaagtattagaataaaattgtataataacggtaagagaaaaaagtaattaaaataattggttttcgagtagcacaattatattagaaacactgacttttaacggttggtgtttcttttttgcactttttgagttcatctgacattctctgctttcccacgtgtgattaccggaaaaataaatttttctaattatataaagtgttgcgactatctttgatgtctgtacgagggtatggggaatcggaatccccatcaagagacttacccggaggtatgccgtagccataaaatggcgatacggtaatacttgggtggatcttgctcttaatctacaaaccctcttacatatacaaaagatggagaagtaaaatacagggtgtgagagaaaagaattttagaaaaatttaaaataactcaaaaacttgatttttaacattgcctaagttaaaatgaaagaaaataagttaaaaggagaacgagaaatatgcttacaagcgtattcgggatttctataaaatatgaagcatggaatcatcaggattcgttgcctgtctatattgcaggaagttataatttttacacagcacatattggaaacagacgctgtataatgcttgctccaacagaagaacttgccacacttccggcattgaaaaaacaaattgtaaaaatacagcagattgataatgtaccagtcgtatttgaacttgcgacagtatctaattatcgaagaaaaagtcttatagaaaataatataccgtttattactgataagcaggtctttcttccttttattggaacaatgctcatggatgagaatgaacccgtaaagcgaattgaaaaatttgtttattccacgcaacagttgttcttgttttatctgtacagtaagaaaaagcgattgtatatttcagaagccggaagagtgcttccatttacagcaatgaccttgaccagagcagtaaagcagttggaagcgacggatttatttcttgtagcaaaagacggtgtcaataagtttattgagtcaaaatataagcgagatgaattatttgaaaaagcgaaagtatatttgacgactcctgttcgaaaaacaggatatatagataagacgcaagttacagaaaatatggtctttgcaggggaaacggcactttctgaaaaaacaatgctaaatccaagtcgagttgttacctatgcaattagtgagaaagattatgataaaaccttgctgactaatgaattgatagacccggataaacaggtaagacttgaattatgggcatacaacccgaaacaattttcagaggataacagtgctgatgatatttccattgttttgtcttttacagatacaaatgacgagagaattgaagaagctgtagatgaattgcaggaaagaaggttgaaggagtaatggtcagagtcttgtcgatttccggactataattctgccataagcttcagaaaaagaaaaagcttacattgaaaatgattttgtgataaactggaattcgaattgtcaattttgcagtgtgacggaatgttttacactgtatttatttttgaattttaggaagaagaggaacaaaatatgccaataggagtgataattaatgccttgtcaattgctgtcggcggtgtgattggggcattattcgggcataaattgcctacgaagcttaactcggagcttaccaagatttttggtatttgttcaatgggaatgggtgtcagttccattgggcttatgaaaaatatgcctgccgtcatttttgcagtgattattgggactgcttttggtttggctgtcaatttgggagaaattattaacaatggggcagcttgcatggagaaaccggtgggaaaactttttccaaataaaaataaatcaatgtccagggaagaatatatgtcgatgcttgtaacaatcattgtgttgttttgtgccagtggaacaggaatctatggagcattggactctggaatgagcggtgatcatacaattttgatttctaagtcaattctggattttttcactgcgatgatttttggaggaactttaggcatggtgattgctgtggttgcaattccgcagtgcgtgatttttttggtaatctttgtagcagcgaaatttattttcccactgactacgccggatatgattgcagactttaaggcatgcggcggttttttgcttcttgctactggttttcgaattgcaaaaattcacgattttccagttgcagatatgattccggctatggtgcttgtgatgccggtgagttggttctgggtgaatgtgatagtaccgctgctataaggtggtagggtaaaaattgagcaaagatttaaaattaagtagaaatttaaaatgagttgagatttagaataagcagacacaattgtgcagaaagacagttaaaagtaagaaaataaaacaaataaatagaacctgctcaggcacatatttgcttgagcaggttctattttattttaaaaagtttcttatctaggccatctgcctttcttatccatcaacggtgcaaacgcctgatgtggttcactctggtaccaataagcaacacttgcaacatcatcctgtcgttcaaacaggcctttataacatactccaatctgctgaatcgtaacttttaaatcttcttcaaagcaaatcggatccatcaaatgccagcgataaaagcctcgcatcggtgggcagtcatcattatgataaggattatgcacgagttcatcatgtgcggaataataagggtatcccaaaaatggagaattataagtttgttctaccgtctttccgtttacctgatgtgcaaagctccaggagccaccaaaatagtcctcggttccggtaccacagatagttggatattcgtcatctccatcaatataaaatttaacttcgccttctccccaccaatatctctcaagtgttgtcaaagcaagataggtaccaacataatgaccttttccttttacattgtccagaatcacataatcctttgcaagttcggtaattctttggcgtctccactgtgcatgaaaataagcggtatcttccggtaactcatcgtataaacagtaatctacttgatagaagaacgcaggaattggattatcatgctgattttctaaagtgatttttgcttttttacggaatggcatttcaaaatagctgttaaagcctctgtttggaacgacagagattggcatagaagttacaagacattctcttgcaaaaccgcagcagaagaagtcacctaaaggactttcgaccgatggagtttcctcatcgtcccagtacatgcgaagcactaaatcgcgaagtacataacaatcggcatctgatgttttattatcaaccgtaatccagatatgctggataatacccggtccatccatttcggctaatataaccgtttcatttggcataatatcttttaaacatggacttccttttctggaaggaccaagatggcttgctgccatcccgccctttcctttttcaccagttggattttctgcatttatcgctctggatcttccgttttttaatctaaaaatatctgacattatcgattcctccgtttattgttttacaccgcctgccatgacaccttccataatctgtttttcaaagattaatacaaagataacgattggtaacaggataacacatccaacggtactaatcaaatcccatggcatactgtatgaggtttctcttgggattgttgtaattgcaacactgagtacttctattttttgtgcaaaaaacaatggtgtaaacaaatcgttaaggcagttgataaagttaatgattaagatggttgcaattgcaggtttcattaaaggcagcgtgatatagaacagtttctggaacatattcgcaccatcaatctctgcagcctcatccattgaaactggaatttcacttaaaaagttacctaaaattaacatggtaaacggaattaacgcacttgtgtacatgataaccagtcctgggaaggtatcgattaatccaaactgtttcattaagtcgtataatggtcttgcggttacgattcccggaatcaaagcagaagccacgattgcagcgtatacaagtgtaagtccttttccggaataacgagtaaatgcataagcggacattaaacagattacagtggataagattaatgagcacacggtaataattgcagtatttaaaatcttttcgcccagattcatttgtgtaaagatccggatatagttatctagtgttgggtgcttcggtatatagtgaattggggaactaaacaattcatctgccggcgaaatagatgatgtaaaaatccaaagtaatggaagtaaaataataaaggcaacgatcaagattaaaatccatttgaatacggatgccaaaattcttttgttttttggtttcattttccacatctccttctatatttaatcaaatttctttatcgccttaagctggataaagcttaaaatagtcataacgataaacaagcaaaccgcgattgcagatgcatatccaagatttaagtttgtaaaggcttcctgcataattcgatatgctaacagtgaggttgaatctccaggacctcctgaggtcatcgcatatactaagtcaaaacttgtcaatcgccacatagtaaagaagatagaaagacttaatattgttttcataatgtttggcaatgtgatggaaaagaaggaacggattggtccggctccatcaatttttgctgcttcataaatgtcggctgataaaaactgcagtgcagcaagtactaaaattgcgaagaatggtaaatctttccataagtcaactgcgataactgcgccctgtgcagaatttgcatgcacaagccagtcaaagtgaaagtccggaacaaatttgcggattagatcattgattaatccgtatgcgtcgttgaatgcccatcttgcagcaagtccggctactaccattggcattgcccatggaatcagtacaatagtacgtaagaattttttacctttaatcttcatatttaacattaatgcaagaattacgccgagtatcagatggaagaacatggatactaccgtaaatattacagtaaatcgaatagaagataacaatttttgatcgctaaagattttaatatagtttcctaatccgataaactgaaagtcagttccttttaacaagctcatgtcataagtgctgttgataaaggtcataatgattggataaagtgttgtagatgctcgtacaatcactaccggaagcaccagaagccatgcgatccatagtccctttgtcttctttttcattgctatttacctcctgtgaaatctctgagatacgatatgaacgactttattttacgacataagtatcaacagattgctgtgcctttttacaaaattcatcgagtgttaattcatcagatacatactgctggaataaagaacccatatcactgatgaattccattgcctgaggagccataggacgcgcaagcagttcagtatctgctacgtattctctgatttcatccaaacctggcagatccattgcagctaactcatcgctttccaatacatcggttcttgccggcagtctggaagtcatttcggtgtaatccagctcgccctgttcactagctgcgtatttaaggaacttctctgcggctgctttatttttggaagcactgttcaggacatatccccatgtagacatataagcggttttgttctcaaatgttggcataggtgcaatgtgctgtttatccgcaccatattttccggaattaacaaaagtctggattgcacctacgtacatgaaaatcgaagcgtagtcgccatcaaagaatttctgcatcattgggtcatactgatcggcaagctgagaaatcggagtttcattattcttcatcatgtcgtacatgaattttaccgcttcctgcgttttcggattagtccaatcatagtaatctccaccaaataagtttacaaacgttccgattgagttaaatacataagttttttcccatgcatcgccatatccgtatttgccgtctgctgagtttgcttctacatatttctcgaagtcttcttttgttttaatctcagtaagacctgcgtttgccatcttttcttcatctacccagaaagcaagaatatccataaagcaaggaacagaataagcattatcgccaaccattgtcatttctttcatatatttctccgggaagttcttcataacttccggtgtcatgaccgtatcctgaagtggctctaagtatccggtgtttttaaatgcactcatcatttcatcattgattgtaatcacgtcgatgctgtcatcgcctgaggaaaggatggttgtgattttggcctgacggtcgtctgtgttggttggacacgcaattgtttcgatttccagaccggttgcttcttcggctttctggatatattcatcaaatgcttttccataagtggtgtcctgtgtcattaaagtgattttgttggaattttcattttgcttggcttctgagcttcctcctgattttccgcagccgctacaaaggccaacgagcatggttgctgtgagtaatacactaacgatttttttcttcattttcttttacctccaatgtttaatatgtactttcgaaattcttctgtcactgatttttgttgacttaatcataaaaaaatacaggtcaaaaataaatatatttttttatgcatgatttatattatttttcgtttttgatgtaaatgattgtattttttagtttttttgattagaattaggctggaaggagtgatacatatatgcagtttgctaaaagattaatcaataccatcaaagaacattttcgcttaaagctactcatttgctttattctctgtgcgatttttcccctttttgtattgggaacgatttcttacaaaatttcttacaatatagcaaaagacaacatgctaaaagaaaccaaaatagcgtgtgaaaaaaatcaaaatctgcttgaaaatcgaatgactcagatagagagcttagcagattcgattcattttaatttatgtgtgttatgcacaaccccggaacagccgatgtcaaaatatcttgataccctttcctcggtgcgaaacaatattacttcgatggcggattcatttaatatttatcatgtaaatgtttttctgccggaggacagttttgtgtcaaatgaaggaatcacgttttgttctttatcggaaatggaagattatagagtacagttaagtgattttgccaatcagggaattaaaccgaagtggctgtttcagaaacgagtgaagtttccatatatggtaagtaaaaacaaaaatcccgtaggcgtactttcatgctatcggtctgcccaaattaattcgcaacaatattgttttgcacttcatataacgagcgatgaattaagctactatttggacgaattttcaaaagagaatccttctgtttcttacataatagatgcggagggaaccatcttagcaagtacggatcagacacaaatcggtacgtctttgactaatgaaaaacggaatgcgcttacccaaaatagaaagacgtctcatatttcatataatgaatgtgaaatcatttcagcaccggtacacaaccagctgtttttgattactgagacaccggattactatattcgtcaaagtgcatcgcttcttgtaaaaatgattttcgtgtgttttataattgtggttccgttgacgatgtttgcaattatctgggtagcggatcaaatgacaaataaagtaaatcgtttgtcacattctatgtctgagcttaagatggacaacgtcatagatgcaacacagattaatgagttggttccggcaacttcttctcatttagatgaaattgatacgctgacggttacttgtgctaacatgattacagagttaaatgcgagctttgaaagtaatctaaatttaaaaatacaagaagaaaaattgaactatcagttgctgcagtcacaaattaatcctcattttttatataatattttggcatctgtgcagaatttattgtcattgggggaaattagcaaagcagataaaatgcttgctgatttatcacggttttacagagggctgttgcgcacctcaaatgatttgattccgattaaaaaagaactggaaatcgcatgtttgtacatggagatggaggcattatgtaaagataatttgtttgattgggatatagagctggaagaaggaatcgaaaactttcttatttgtaaatttacgttacagccgattttggaaaattcgattcagcatggtttaaaaggcaatggaatccatatgcatatccatatttctatcacctatgatgatgatatgattgaaattataatttcggatgatggaatggggatgtctcctgaaaaattaaatgaaattcaggaaagcattgaatccaaacagattcattatgagaagcattttggtatcagcaatatcaattcgcgaatctgttcttccttgcaaggtcatggtacacttaaagtagagagcaataaagattcaggaacaacgattcatatcagaattccgcagttactggaggattagtaatgtacaaaattatgattatagatgacaatcatatctcggttgatgggatttgtcataatattgactggtctgatttaaatgcagaagttgtttgtaaagcgtatgatgggcagcaggcacttaattatttgcagaataatttggtggatttgattatttcggacattgaaatgccacagttagatggtttatcgcttgccgaaaatgcactgaaactgaattcctctataaaaattatcctgatcagtgcatttgataaatttgaatatgccaaacaagcgatacggctgggagcatttgattatatagagaagccacttgattatgcttatctggaagaaatcattcgtaatgcgcttgatatgctcgataaagagcagaagaatcttgcaatcttaaaaaagagtcgtccaatcatggttgacaattttttccataaattaatacaatcttcaagcgatgaagcgcgatatacactctcagattatgcaaattatcttcaattaaacttggaatatcattactatcaggcgattgtcattcgaatacaaaacgcagtagaaatcaaagaaaaaaacggaattgaagagtatcatataaagttaatgagcatgtcggatacgataagagaactttttgataaaaactttgctttggtgcatactttgtcaacttttgatgaaatcgtgttgctgcttgggcataattattcaaattcaaagtacttctacagtacgtcatatggattgttgacagagttaatacagatgtataagcatcatctttttgaagtaaatattggaattggcagcattgttaaatatttgtggtcgttgtcgtcttcgtattcaaatgcattaaaatcactggaatatcgttttttctttccacagaaagatatctttacaatcagtgatacagtagacaaagattatgctgtagagctatatgaggtttccggaaatgaagaactgatacagctgttgtgtaaaaatgatttggatggagtaaaaaaatggattctctcattttcagaagaattgacgcaaagctataaaaacaaacaatttatctttttgcgtgtctatcagcttttggggcatttactgaaatttctttgtgacatggggcttaacatcaatgatatggaaaaagatattattaagacgtaccaacagcttgatgcgttctcgacaagtacagaaattttccaatggctgtttcgcttgtgtcagacaatttctgatgaaatgaacctttcaacgaaaagccatcaagagcatgtttgtgctgcaacgttggagtatatacagcagcattatcaggataacacattatgtttgaacgaaattgcggaaaatgtacatatcagtccggcgcaccttagtgcgctatttaaaaagcagcgccagcaaaatatttcggatgtaattgcagacattcggattgaagcagcgtgtagtttattaaaaaataccagtcttccattgaaagagataagtgcgaaagtaggctattcaaaccaatattactttagttcttgtttcaaaaagaagaccggtaaaacaccttcttcgtacagataaaaaataatcggctgctttctgtattattttcaggaagcagccgatagctttctactcggagattattctttttattcggttttgaaacaaaaaagttcaaattctaaagttcgtgtagctacagcattatagagcagctgctttttgaattcgatattccgtaggtgtcactccataatattttttaaattgcttacaaaaataatcaaccgtttcaaatccaacgttttcagcgataacaattacttttttctttgttgtagtcaaaagaattgctgcttcctgcaatcgatattttagcaaataatgcaccggcgtatcatgaagatatttgtgaaacaagtttaacgccgtgcttttgcttaccatggcctgttcggcaatctcttctaaagaaagtttttggttaaaattttggtgaatgtattgcatcataagttgcagtcggccttgtgatgaaacaatatttacttgtttttcttttgataaatcttcttttatatgggagtaaatcagataccaaagttcttgtacaagacaagaggtgagcagctccatttcgccttcttctatttggagtgatattatttttttcataacatgtaaagcttctttttgccaggggatttccggtgaaaaaaacaaacaatctaatgctgattttttaatgggttcaatgtacttttgataaattcggctgtttgaagctgcaataaatgttggaagcaggagaaaatttggaatgacggctcctttttcagaataaaagcgatgaagaattccggaattaacccagaatccttgtccttcagttatggaaaactgtttttctcctgcccaaaatatagcatttcctttttcaacaaacacaaattcgaattcgttatgccagtgccattcgatacaattaaaatcaaataaagacagattgtcataataaaagtgaaatggataatcgctacgaccatgctgaattgtttccatcatattttcatctgtcaaaattttattgtagtaggtgttataatccatgttttttctccgtatttcttctccataatttttgaatttacgatattatacaataaatatctgatatattccagtgaaaaaagagtgagattgtgttattgtacagtagacgtttttgtgaaaaagaacgtagaataaaaaaataagcagaaaggaaattttttaatgaaaagcaagtatagaaaaacattaattgcctgctatttaggattcatcactcaggcaatcactgcaaactttgtgccgctgttgtttttgatgtttcacaggacttatcagatttcacttggtaagattgcttttatttcaacagtgttcttttttacacagttgcttgtggatttgttttgtgcaaagtatgtagataaaattggatatcgcagaagtgttgttgcatctgaagtattgtccggagtaggtttgattgggctggctgttttaccggagctgctgccttctccttatgttggaattttagtcagtgttatgatttatgcaattggaagtgggcttattgaagtacttggtagtccaattgtagaagcatgtccgtttgataataaagagagtgttatgagtcttttgcactcattttattgttggggttcagttggagtaatcttgctctctactttattctttgcaatttttggaattgaaaattggaaaattcttgcatgtatttgggcagtgattccattgtataatatctttaattttctttcttgtccgattgaatctttgacggaagaaggagaaggtatgagtatcagccaattattccaaatccctattttttggatcgcaattattcttatgatttgtgccggagcaagtgaaatttctatggcacagtgggcatctgcttatgcagaatccgcacttaatattccaaagagtcttggagatattgtaggaccgtgtctgtttgcagtcatgatgggagttagtcgttcattttatggaaaatacggtgaaaaattagatttgataaaatttatgattggttcaggagtgctttgtcttgtttgctatttgcttgcagcattaggtccatttccgattttaaatcttgcaggttgtatcgtatgtggcttttcagtcggaattatgtggccgggaacaattagtattacttccggtaaaattccgcttggaggaactgccatgtttgcattacttgcgatggcaggtgatttgggtggatccatcgggcctggtgtgattggggttgtgactcagaatgcaaatgataacttgaaagccggcatgttggctgcctgcgtctttccggtagttctgattttatcggttctttttattagaaaaaagagagctgaaattaagccaataaatcaaaaaacagaatcttttttatgagataaagtttgaggtgctcgcaaaaagcggcacctctttttgcgttatattattttgttttgacaggattctgaattcatttgatataattacgaaaacagactatacttaggataataaggtttgcgtttgcaagataaataagccaaagcggaggaggaaaacagtgtcaactacccacctcccaagggaagtgggggttcgcttatgataaacgaaaggatgtcatgcggcttgtggtattttgcaaatgtctatagatacccatggtagaaaggaaacgtttatggagcatttgcgttgtgtagtagagcgaattacatatcaaaatacagagaatggctacacagttttgaaatgtgctgtgaaaaattataatgaccttgtaactgtggttggcacaatgccggatactcatgttggttccgtattatcgctcgacggtatgtggaagatggatgccaaatatggacggcagttttctgtacagaaatttgaagaaacccttcctgcaaccgtatatggaatagaaaaatatctgggttctggtttagttaaaggtgttggaccgaagtttgcaaagagaatcgtgggaaaatttggagaagataccttagatatcatagaagagacaccggacgaactgctgaaagtgccgggaataggaaaagtcagagtggatcggataaaaacgagctggcaggaacaaaaagaaatcaagaatattatgctgtttctgcaaggtcatgaggttagcacttctcatgcaacgaaaatttttaaaacgtatggaagtgagagcatcgccattgtaaaagaaaatccgtatcggctggcagatgacatctggggcattggatttaagacagcggattcgattgcacaaaagatgggaattgagaaaggaaaatttatccgactgcgcagtggtattttttatactttgaatagacttgcagagttggggcactgttatgccacaagagaacagttgattgaaaaagccagtgtccttctggaagtagaacagccggaactggagattacattagatgaaatgctccgtacgaatgatatcattcgagatgtgtttgaagaaaaggaagcaatatatcttccaccttattatttttcggaaagtgtatgtgcaaagagactggttcatttaatgtcaggcagacaaaaaaagtgtgagaatccggaaaaaattttggagaaagtggcacaatcatcccaaattatttatgatgagatccagtggcaggcggtgaaaacagccatttcatctaaagttatggtgttgaccggtggaccgggaaccggtaagacaacgacaacattaggaattatttccgcatacaaacaggcagggtgtgagattattttggctgcgcccacaggaagagctgcaaagcgaatgtccgaagcaacgggcatggaggcaaagaccattcaccgcttgctggaatataaaccaccggaaggctaccagaaaaatgaagatcatccgttggaaggggacgttttgattttagatgagtgttctatgattgatatcatgctcatgtacaatcttttaaaagcgatgccggagcagatgtctttgattttggttggagatattgaccagcttccaagtgtaggtgcaggtaatgtcttaagggatattattgattcgggacaagttccggtggtacgtcttaaccggattttccgtcaggcacagggaagtcggattattatgaatgcacatcgaatcaacaaaggggaagggattgatatgcgtggcggaaaagatgcagattttttctttgcgccaaaagaaagtaatcaggatgtcgtaaatacgattgtccaatattgtaagacaaacctgccgcgatattatcatgtagatcctttgcaggacattcaggtattgactccgatgcagagaggagaatgtggagcgattaatctgaatcaggtactgcaagaagcaatgaatccatcaaaaatctttttgcgaaggggtggaacgcagtatcggctgaatgataaagttatgcaaattcgaaatgactatgagaaagaagtatttaatggagatatcggtacaattacaaaagtagacatggaagagcgggagttgaccgttttatttgaaacaagggaagttgtctacgatgtgacagaactggatgaactgatgcttgcttacgcagttacaattcataaatcacagggaagtgaatatccgatagtcgtcatgccatttacgatgagccattttgtgatgttacagagaaatcttctctatacaggagtgaccagagcgaaaaaaattttggtactggttggtgaaaagaaagcaatttattatgcgataagaaatgaaacgacaaccagaagaaatacctgtctggcaaggcgtttacagtcggatagtgaagaatcaaaggaagccttcagccatctataataagtgaaacaccgtccacatggttagaaaggaaatgtttcaaatgatatatattacaggagattgtcatcgtgaataccggagatttaatactcaaaattttccggaacaaaaaggaatgaccaaagaggattatgtgattgtctgtggggattttggcggagtatggagttttgaaaaagaagataaagaagaaaaacatctgctcgactggctggaagaaaaaccatttacgacgctgttcgtggatgggaaccacgaaaattttgaccggctttatggatatccgattgaaaactggcatggtggaaaagtgcataaaatcagaccctcggtattgcatttaatgcgtggacaggtctttgaaatttgtaatagaagcatttttacctttggtggagcaagcagtcatgatatcagcggtgggattttagagatggatacatcgaattttcacagagagataaagcgtttaaatcgagtgggaataccgtaccgtattaatcattggagttggtgggcacaggaactgccatccaaagaagagatggaagagggacgaaagaatcttgaagagcataataatacggtagattttattgtgacgcactgctgtgcttcgagtactcagcagcttttggggagagagggatttgaagatgatattgagacaaggtatttggaggagatactacagagcacaaactttaagaaatggtttttcgggcattatcatgacaatcagaacgtgacagaaaaagaaatattgttgtatgagcaggtgataaggattgcatgatatgaatcaagcagatattcgcaatttgtctctctgattgattcggttaaaatcataaaaaagacgtcattccatagaagatgattcctctatggaatggcgtttttaatttggtgccttgtctggcgtctgacaccggtcaaagcaggttaggatgttgaatgcttctgtcagagagagttgaaagctccctctgacagatcgcaaagtgactgcgttcatgagcaagtagtgaagtggattgcgaatgtccgctttactgattttgggtggtgtttgacgctgattcttttgattcgttttcttttttctgcttttgtttgaagtttttaacaaattcaggatattctttttggtgcatttgatggttctttatgaaaagattaaagtgttcaggttcacttatgatttcctgtgatggatataagctgtttttgcgtatttgaagaagaacattcattctttcattttcatctggaataaaataagaattactgcttataaaagattcaaggaatactgaacaattagtaaatacagctttatcaggtgttaaaagtctttttagtgtttcgtctttacgcaggtcttccagagtgtcttggtctatgacgattggagtagaatttagtgataaaattccacgtagcatattggttgtattaagattatcaagattttgtcggactcggaataatgccattttttgaaagagtggttcatgagttttgttagtggaaaaggtcagcataccagcaggaatataatatcgaatatcagaatttaaatttaaatatcgaaacataagagccatagccctgcgaccagtatcgtctgaaatgaaactatatgctatagatggattttcaagaagtttcaaatcaccagtgagtttaaacagaggcatagggtctccataaaaagttgtatttgtttttatttcttcaaaagttacgatggtgcgtccttcggttatgttaacattcattttggcttcttgaattttgccatctttaataggttttaaatgttcttgatggtgtttgggattaaaataataacaatagtagtcataagcatgatattgattggtaagctgatgaatcccagagtctttaagtttcccttttgtaatacgggaaaagttaaagtcagatgaagaaggagtctctgttgtttccggaagctcacagatactccataaaggaatatcaaaaatctgcgcaagtgcgacaagctctggaagttttacttctctgtcggattcaccatcgagcatagcgcgtattttactgggtgaggttttgatattaaaccgttgaaacatcatatctgcgataccggaataatttaaagtctgttccccgagagcccgttcaaaatctctcttccatttaaataatcgtttctttacaagggaattataatcttgatttccgtttgaattatctgaagatttagagttcataaaaattcctcccaataataaaaatttaaagaagtataactattttcatcatatcattggtacgacaggagttcaatgcgaaaaaatgccaaaaatgaatcatattatatcaaaaataaaaaatataaaaatcaaatctgttataaataaagttaataagactaatgataaaaaataataaatgtgataatattacagtacatcagatatctgacctttctaaaatctttttaataatcagagattttgaattttaaaagaacagagtttcaattttaagatagtagagtttcaatttatggaaaattagagaaagatgaaagtataaaattatgtttaaataacaagtgtaaaggacaagggataagtttttagatggtaaaaaataagggagcgtggtattatgtataagtgactttgcaaaaatggatttataaaaatcagagatacaaaagagaaacagaagaaaaaatctgatagagaagaaaaaattaagaaagaaaatatatcagaggggaaacggaaaatatgagcgaattttcaactgtattatcgcggtttgtgaaagagaaagatgtcaacgtataccgtctggcaaaatattgtggatatgacagagctaatctttataaagtaatgcgtggagagcggaaaccgccgagtctggaagttttaaatctgttgtgtgaatatatgcatctttcaccggcggaggaagaaattttagaagaaaattatgagattacaatggtaggacacgataactattatcgaagaaaaaatgtaatgaaatttttttctgacttttcaatgaccagtaatttggaaaatgtactgccaacagtagaaattaaagaggactttgaaattccaaattcaagttatatgctgcttcgcggcaattatgaaattaattctgcgctttttcatattattgcagatgaaacaaaaaaccaaaaaggacatattcagatactggcacagccggaacatgcgttaggaaatctgttggcaatgcgtggaaatacttcaaacgaaataataattgaccatattatctgcctggataacaaaccggagattgcatattcaaaatcaaattatacgttagattgtctgaagcatattcttccattatataattacaattacgattataacacctggtattattatgcagaccttggttcattgggaagaaatttctctgtatttccgtatatgattttaacttcaaaatatgtatgtatgctgtcggatgatttgcaggacggatatttaagtaatgacccggaactgattaaaatgatgaaagagcgttttgaaaactaccggagacgggctcatcggttagtggaaaatgtgcagggtgaaattgaacagcagtatatgattatgggaatgttaatggcaaatccttatccgaaatatgcatttcatatgtctccatgtatgatggcagtattagacagagaattgattgaaaaatatctggtgcctcagcttccacaaagagaagaattagttgaggtattatgtgagtatatttcaaatcttcaaaaacaggatatgacttatgtctgctcaatggaaggaattttacagttcattgaaacaggaatcatcagtgaatttccgaaagaaatgtatcagcttccggataaagaagacagaatggagttagtgaagcgactttttgatgaagaaaaagccggaaaagtacatattttgaaaaaaaacattggagatttaaaggcagaattatatttatgcattacaccggaaagcggattgctgcgatttgcagttccatctaagaatgttttaaaagatatctccttagaagaatcaggtttggtttcggtgttctatgacttctgtgaaaatttaagcccggaattattttattcggaagaagaagcaaagagaattattttcggataaatgtagttttaaaatcaagcacagaagaattatgagagtacatataatcagaacagagttttttggaagaaaaagccggaaagctctgttttttgttgtacaaaagtagaaaaacaggtaaaataaaagaaaaattgtcgaaaacagaggaaaatgatttgaaagtttgtatgaaatgcaagagagcatttgaagacgaaaagaaagtttgtgatttttgtggggaaccactaattgaaatcagagaaacggatggagtaaaaaaagaaagaataaagaaaaatccaattgtatttgcagtggctggaattgcgatcgcattggtggcgggacttggaattggttcgctgacaatgaaacagcttgtaactggaaaaaatgaaaaaagtgcggtgcaaagccttgaaacagatgaggaaaacgtgctcggagaagtaaaaaaagaaaaaggtgtttcaattgaagatgaggaagaggaaacggacgaagatgaagtgccggaaattaaggtaggggaaacctggactgtggatggtctgtggaagattacgattaattcggtgacggagacggaggagagagatagctataatgatagagaaaatccagaagctgtttatattgtagattatacgtatgaaaatctgggatataaagatgagtactcaaaaggattaggctttgatttagacggagtttacagtcaaatcgtagattccgataaagagatgggctatcactattatatatcaaatcttaattcagttgagcctgtaccgataggggcaagaaagactgttcagacagcaataggggtgaatcataaaggaacattttctattttatatgaaagagatatagaagatggagaagatgaagatgagtataatactaaagtttacaaagcaaagtttatctgtgaagtgaaagagtaaggagagcaggagtatatttaagaggaaagagagaaagaaatatggcattaatggaaaagtacgatgcatttatcagctacagtcatgcagaggataatgcagagattgcggaggcacttcataaaaaactggagcattatcggattccttctcaaattcagaaaataacaggaaaaaagaaaatagaacgagtctttcgggataaagaagaattaccactttctgcaaatctcacagaaaatatttataccgcattagataattcagaatatctgattgtgctttgttccccggaatcacgggcatctcaatgggtgcaaagagagatagaatattttgcaggagttcatggaaaagagcgtatctttgcaatattaataaaaggagaaccggaagaggtatttcctccaattctctgtgaaaagacagaaataaaaacagatatcaatggtcaaaattacataattacagaaccagttgaaccgcttgcagcagatgtcagaggatattcaaaaaaagagaggataaagaagttggatgcagagtttttgcgtttgatagcaggaatcctgcagtgtccttatgatgagttaaaacagcggcatcaggaataccgaatgaagattgcaattgcagcaatgagtgcagtcatgtttcttggaatcgcatttggcatgtattcagcatatcaaaggaatcaggttaatacagcatatcagcagtcattaataaatcaaatgaagagtctgtcggaagaatcagaacgatatcttgatggaggagacaggataagtgcactaaagacagcacttgaagttcagatagaaggacagagcagtatttatccgatagtaccggagcaaatctatgctttaaataaggcactgtatacctatcagcgttcaagcaattatatttataagccagaaaaaatgaaaaccatggatggggcagtaacagaggtaaatggcttcagttcagatggaagtttgttttttgcacttgattcctttggacaagcttatttttatgatacagacacagaaaaagtggtatggaaaattaatgcagaaaaagttttcgaaacaacaggagaaaattttatctggggtaaatttaacggaaaccattcgattgtgatggcaacagaacattactttgtggcattggatgtagaaaaacaatcctgtggagcgattgcgaaaacaaaaaagaaaaatcaaaaagatcaggcgatggatttgtataaaaacaaattagcggtgtgttataaaatcaagaaagaaaatgccaaatatgacagtatcagtctgtttatttatgatatggaaaagggggaactttcagagacgtatgattacctttcagaaaaagaaacaaaatatatagctgagattgatcagattagtaaaatagttttttcagaaaatggaaattatttggcaatatcaaaatcgtggcgtagcctaagtggtgaggacgaacaaagtaaaatgatttctatttatgatatgaaaaatggagaaattgttcagaggtttggaacgaaaagtgttttagatctttgttttatagatgaagatgcagttgcttcggtagaacatagctcatctttatcgccatactataatggatgggaaatgcaggaaagtatttacagtctaaaagatggaaagagcttgtggcaaagccaaaagactagaataacagatacgatagcagtagataacccagccgctttttgtaaatatattagtaaggttaatacagatacgaatggagaaaaggcagaagtagttggatttagctgtgaaggaaatttgacattggtaagaaaaggcgattgggatattctatttcagaaagattttgaatatgatattgtggaaattcaaaagatagatgacaataatattttggttggacttaataatggaaccgtttatcgtgttatgacttgtagtttgtggagtaagatgttgattgtagatgctgatattagtgaagaatattacaacgcaaagatagataaaattgttcagctaaagtcacatgacttagtattctcaaaaaagatatttgatgaatctatgaaaaaagagggaacaaaacgaccagaacttggaaatgatgtaaccaataatgaaggagaaaaagtagttggaacaaagtacagggcagaagttgaaggtgattcaattattataacggacagaaaaacgaaagaaaccgttttgacaattcccatgtatcaggcagaagagatggtttacggattttttaataatgatgaacaatttttggtatataatgaacagtatgaggaaattgtagtctgggatatggaaacaggaagtattttaaaacagcaagaactggatttggaatccccggttaaaacacaaatcattatagatgaagatttgcatctctttgcattaaatcttgaatatggaaacatatcgtttacggctgaagaaacaccacataatacattagatcttttttattacgacgatgagtttaatatttatcggtatgcaagtattccttatggggatattgatttcaaaaataagaaactatatgtaagagatgggcaggattattattcgacatggatttacagttatgatgaactggtggaaagagcagaaaaaattttaaaagaaaaatagaattaatagtggcgaaaagtgatagtgacggagttttctggtttggcggaaagctccgttttttgttgtagaatttcagcaaggagtttcaaaatttgaaaaagatgggagagttgaaattgggagaagatggtttaataaagatagaaagtgaagagaaaccttattaaaatctaaagtaggaggaagaaagtatgtggattattataatttattatgttgggataccattaagtgcaattgcgggtatggcagttattttgtattatctttttggagaacatggagagtggataggaatggcatctaatattatggctttgtttatgttagttggggctgtaattggatttctttcatcattgcatgaattagtttatggtagattgattaaaggagataaatcagttggaattatggaaaacttgtttagtatgttggtatatggtggtttagcttttatgataagctgtttttttattagaaattatctcatgtaagcaagtgaaataacttatttgagagagattgcgtctcattttaaataaaatttgacgacaaaaatcgacacgtattgtgagaaaatatttaaaaaggtaaaataaaaagcaagaataacagcttaaagggggaatatttcttatgagaaaagaaaaagaactaagtgcaatgaaaaaattcatcaagaaaatggcaattgcagttcttacaggagcaattgcattttcggttgtacccgcaacagttcaggcagcaggatggaaacaaaacaagaatggatactggtggcaggaaaatgattacagttatccgaaaaatcagtggaaaaccatttatggaaaacagtatcattttaattcaaagggatatatggataccgactggacgaaggtagatggaaaatggtattactttggtggaaaaaatgatggagcgaagaagacttactggcaaaaggtaagaggaaaatattactggcttggaagcaatggtgtgatgagaacaggctggcaaaatgtatatggaaaatattattggcttggcagttctaatgacggagcaatgaagacaggctggcaaaaagtagggggaaaatactatttacttgggaaaaatggtgatatgaaaagtggctggcagactgtatatggaaagaaatattatcttggcggtgcaaatgatggttcgatgaaaacaggttggcagaagattggtggttcggattactactttggaagaactggggaatccaatgagggtgttttaagaacaagtacctgggttggaaattattatgtagattcatcaggaagatgggataaatataaaaaaatagatacaagtaattacatgttgaatggaaaatataaaaatttagtatcggatttgggaatgcaagtaatcgataaaaagtcaaatcgttataagaaggataaagtagagttatattggatgcctggagattgttttggagtgacaaatgaagggacaagttttgtaaatgtgtatggaattgtacctggagattccttgaatagagctagaagtatattagtaaataaaggttggacagaagttaatggatatagtagtaatagctataattatgtatttctaaaaaaaatagacgaaagacttcatatggtagaatttgatacgaattcacgtggaattttgcagaattggtatttgatgaattggccacaaggtgagtgggttctagagtattatagcatgaagtctgaaaatgcggtagtaatggaatcaccacagcaggaatctgatacaacagaaactgaaattccagataccgaggcaaatagcgaagaacctgcacttccagaaacaacagagcaggaaacttccgatgcgactcagaacgagaataatacaacagaaatagaagaagaacaggcaactcaggaagaacaagtttctgaagaagagtcaaccgaagagactcagcaagtagaagaaaataaagaagaaaaccagtcatcagagatgataaatgaataataaaatactgtccgagttaaagggggaaaagctaatgtattgtaataattgtggcacacaaatggcagatggagcaaaattctgccctaagtgtggaataaagatggatattcaaaatccggcaaatcaaaatccagtaaatcaaagcatgggaagtccaaatatgggaaaccagaacatgggaaatcaaattccgaataataattatcaacccaatcctgcacctgtttattatgcggctgattcaggtgaacttccaatgcgatggtataaatttgtgatatgggttcaattatttcttaatgcattgttaagcatagtttctggaataatgactatgacaggagcacattatcaaggacaggcaacagtggtttatatggtttatgggagcttgaaaggattagatattgtaatagggattatgatgcttgtattagcaggaggagcaatctgggtaagacagatgctgagtaaattccagaagatgggaccaactgcttatgtaattcttttagcttcaaatggtgtagtaaatttgatatatgcgattatggtatctgctattacaagagtgaatgcgtttagcaccactgtaatttctcaaattgtagcaagtattgcgctgtgtatttgcaattacatttatttcaataagagaaaatctatgtttgtaaattaatcaaaggagcatgtagagagtaaaatctttgcatgctgtttttgcgttcaaaatttcaaaaaataatttcaaaattaaaaaaatatacagtcaatgaaatcccaggaaaatgttttaataaagacagaaacaaagtgcaatgcgtcaaaagataataaagattgacgacaaaaatggacgcatattgtgaaaatgcactaaaaaagttagaattacattgatttaacagaaaaaaacacgaaaaggagaaaagtatgaaaaaacaagggattttgaaaatttttgaaggaatgatgttgattgcaactacaacagcgtgtggttcaagttcagcaggagtaaaaaacgttgatttaaaagacccagatggagattatcatgttcaggttgattttaaaacaaatgaagtaactctttcctgtgatgtggaaaatgatgatacgggaacaggcgaaggctggtctgaaattttaaaagcctgcaatagagagcaggattcagcaatcaattttgaaacaatgtcttttaatacaacttataaaatgtcagacgattttaagaaagtattcaaagatttttgggaaaatgattttcaaaatgaatactcaggggttgaaattaatgaggatggaacgacagcagatatagtggacctttgcagatttttagcattgggagaacagtgggaagaaaatccgaatttacttgttacagaacgtccggttgttgaagatggagcagagggagcagtagaagtatttgtaacgtatgatggaaaggaagaaaaatttcagaaagcagatacagataaagatggatacatttcagtacaggaatatattaaaatgatggtttcaaattatgaagaaaccataaaagaatttgagtcaatataaaaatagcagaaggggagttggtttaaatgaaaaaatcaaataaagcgttaagtatcgtaatttcaattatttatgcagctgttgctgttgaatggattatttcgattgtatcacaatatctgaagataaaaggtggtttttcacctgtagcagaaattttatattttgttccggcagtattgatgttaattattgcaggtctggaaatttatcgtttggtgaaaggaaaatataaagttcttgattcggtattatttttaattttgccatttgtaatgtgtatctctgcatttgtgcttgcaccaggtattgtggatagcaatggagcatatcatgtcagcatcataagctctgtgagtctgatgtattttgtaaaagatttagttgcaattgtagcagggcttgtggctcttgtactggcagtgattaagaagaaaacagaaaaataaaatgactgtaaatacagtaaatgcaatatgaaaaggaggagcacaatagatgaagaaagcaaaaaaacctaaaacgatgaaaatgcttatcaaaaaaatagcagttgtagcttgtgctgcaacgcttgcattttctatgatacctgcaacagttcaggcagcagggtggaagcagaacaaaaacggctactggtggcaggaaaatgattatagttatccaagaaatcagtggaaaactatttatggaaaacagtaccactttaattccggtggatatatggatactggctggacaaaagtggatggcagatggtattatctgggggcaagaaacgacggggcaaagaaaacttactggcaaaaagtgtatggaaaatactattggcttggaagtaatggtgtgatgagaactggatggcaacaagtatatggaaaatattactggcttggcggttcgaatgatggagcaatgaagactggctggcagaaagtaggaaaatattactattggctcggtcattacaatgatggagcaatgaaaactggttggcaaactgtctatggaaagaaatactatctgggcggagcaaatgatggagcgatgaaaaccggatggcagcagattggtggatattggtactattttggtggagtaaatgatggttcactcaagacaaatacctggattggaatttatcatgtggatgcgaatggtagatgggataagacgaaaagggtagatataggggagtatttaacagataagaaagatgtgcaattagtaaatgttctgggtttaattcagacaaagtcagaatatggaagaaaagaatatgcacgagatcaaataacttattattatcatgatagtggttctggtacttattctcacacatttggaattacgaatgaaggaaataaatatataaatatttatgggattgttccaggaaactctctgtatgatgcaagaagcatattgaaagccaaacaatggaaagaggcacaagagaattatagtggtgataaatatgattatttgttccttaagactataggaaaacggtcatatatgattgaaattcatactgattcttctgaaataataactagttggtatgttatgaattggccacagggtgattttacaagccctgataatttgaaagagatttcattggatgcttccttagataattcttcaccagtagtatttcagaattcagaagaaaataaagctagtgttcaggatgtagaagaaagtgaaaatcagaatgaatccccagttgtaattccagaagaaacacagggagatgaacagaatggcgagcagaacttagagcaggatgaaaataaagaagtagaacaagatacaaaagtagaacaggatgcagaaattcaggcagatgcagaaatttcagaacaaccttcagaagaatttcaatcagcagaaactcagaaaaccgaagaacaagtagatgaataaacttaagaacctgtggagagaaatctctgcaggttttttgacttttattaaagtatgatagtgtggtataataaaaataaatcaaaagagaataacatgatactaaaaggagttagaaatgataaaaaagcaagaacttacgttggaagaaaaagaagaaaaagttcgagattttcgtccaatagatgatgctttttttgaaacgctggcagatgatatagcattttgccaagagatactacgagttatattaagtgataaaaaattagttgtagaagatgtaatcgtacagaacagtaaaagaaatctgtatgggcgttcggtaagactggatgcattatgtacacttggaaatggaacaaaatgtaatatcgaagtacagcgatcgaataatgataatcacttaaagagggtaagatataatgcggcaagtatagcggttgtggattcccaaagaggggataaattcagagaactggaagacttatatgtggtgtacatttccgaatttgatgtatttcatggcggttatacaaaatatcatgtggacagtgtagttcgagagacaggaaaaaaagtaaaggatggtctggagagagtctttgtaaatacggagataaaagatggaaccgaactttcagaactaatgacttgtttcttggaaaaagaagtagataatccgaactttccggagttttcgaagcgaatgaaatttttaaaacatgaaaaaggaggtctggacgcagtgtgtgatgtaatggaaagatatgaagagattgcagcagaaaaagcagaagaaaaagcaaatattaaggcagtgaaaaacatgataaaagtatttcaggcaacaaagcagcagattttacagatatattcggaaaaagaatatgagcaggctgtgaaagaactcgaagaggaagaaactaaataaaaaaataagagacaaataaaataagtgataaagaaactaaaaggagttagaaatgggagaaaagcaagaacttacgttagaggaaaaaaaagaaaaagttcgagattttcgtccgatagatgatgctttttttgaaacgctggcagatgatagagcattttgccaagagatactacgagttatattaagtgataaaaaattagtcgtagaagatgtaattgtacagaacagtaaaagaaatctgtatggacgttcagtaagactggatgcattatgtacacttgggaatggaacgaaatgtaatatcgaagtgcaacgatcgaataatgataatcacttaaagagggtaagatataatgcggcaagtatagcggttgtggattcccaaagaggggataagttcagagaactggaagacttatatgtggtgtacatttccgaatttgatgtatttcatggcggttatacaaaatatcatgtggacagtgtagttcgagagacaggaaaaaaagtaaaggatggtctggagagagtctttgtaaatacggagataaaagatggaaccgaactttcagaactgatgacttgtttcttggaaaaagaagtggataatccgaactttccggagttttcgaagcgaatgaaatttttaaaacatgaaaaaggaggtctggacgcagtgtgtgatgtaatggaaagatatgaagagattgcagcagaaaaagcagcaaaagaggcagcagaaaaagcaaatattaaagcagtgaaaaatatgattcaatttaatatttcaaaaaacatgattttgacaaaatattcagaaacagagtatgagcaggctgtgaaagaactcgaagaggaagaagctgaataaaaaataagagacaaagaaatgataaagaaactaaaagaagtttaaaggaaatctataagtaagaacgatctaaataaaaattataacgtggtgtaaaacagtatgtggagaaaaaagtctttgcatgctgtttttatatttaaaatttcaaaaaatcatttcaaaatttgaaaaatatgaagatactgaaacttaaagaaaatgttttaataaagacagaaacaaaaagaaatgcgacaaagattgactacaaaatatgacacgcattgtgaaaatgcacaaaaaagctaaaattatagcaatatatcagaaaaaatgcgaaaaaggagaagcgttatgaaaagacaaatcaattttaggggggaggtaagcaaaataactccataaaagtcatagtgtagtcagtttgatttcaaaaagaaaaggagttgttttatttaaatgcgaaaaacaggaaaagcatcaaataatataattaagattgtgtacatacttttggcaattatatgggttgcagtcagtttgctattctttttggtaggcagtaatttgggttcagttggcaaagtactttattttcttccaacggttgtaatgctgattgtaattgtagtaggaattatacatttatcaaaagataattacaaaaccagagatgctgtagtacttgcggtattgccgtggatttttatagttgttgaatttgccgtgtcagtgagtcaggatgccagtagagcaagcattgaagtgttcatgggttctttctttcagggcgttataactggaatcgtaggaattttgatttttattgtgaaatacacaaaacaggatatccaggagaatgaaaaattaagcaagatattagataacatgatgaaggcagtatatgcaattgcagcagttatctgggttattttaagcatctttttattcacgagacttagagagcctgttataggtgcaaagataattatctactttattccattattagtagttttggcaattatcggaagtcaaatttatttccttatgaaagaaaagcatacaatgataaatgctttaattgttacagtattaggatgggttttggcaattattggattcatgaatttatcaagcagagactttgattcattaggaattgcaatgttcgtaggatatatgtttccggcactggcagtgggaatacttggaatagtagttgtagtgctgactgcaatgagaagaaaatacagtaaataagaagtgcggatgaacctgtggagaggagtcttcgcaggtttttttggcaaaataaaaagtgaagctcttcctgtgaagatttcttgtttgaatggcaaaatggaaaatatgaatataccttacgaggtggtcgtttagtagcgatgtttacagtaaaatttacgcctaccgcagcaggtatgagaattcaggttacacagcaggatggacaaagatactcttgaatagggggatatacaggaaataataacgtaaaaggacaagatattgaatatagagagcggagttttgtagatttacagaacttcgcttttttaaagataatacagaactgattaagagtttcaatttatacagaaaacagtttcaaaaagtggataaataaagaaaaatgaaattaatagaatatggtttaattaaatcagggaaaagaagacaagttgttattttcttattataaaatttttgcgtctgaaaacaaataaatattgccgacgaaaatggacacatattgtaagaatatagtgagaaaaggtaaaattaaaacaataaaatcgaaaaatgaaagaggaggaaaagaagatgtattgtggaaattgtggaacacagaatgatgaccgtgcaatgttttgccagagttgtggagcaaaactaaatggaggaggaagtcagaagcagcagcaatatgttggatttggaccgggtggtcaaagtacaggatatcaaagtatggtatatgaatcaaaaggaatcggaaaaacagcaatggtctctaaaatcgtttcggttgttctgtttgctattatagcgttatttttctttcatgcggctgatgaagcaaagtattcaatacgggcgtggtcttatgctttacagacagggaattcattgtcaagtaactattcaataatgggaacattttttatgataggggcaattggagaattgattgtacttgtattgtattgcatttcctggactaagattgacagcgttggtatcacagccagttgtatggggttaaggcaaaattatcagatatcagacatcacaagtgtcaggacattatttggaatttttgtatttattcatggaaattcaggaacgagaagaataattgtagatgatcctaagagagtacaggggattttagagagtatgatatatagagtttgattaaagagaaaaagattattgcagtaacggagttttgtaaatttgcagagctccgttcttattatcagaagaggagaaaaaaacatggatgaattatatgtagttgttttagaaattagtgctgaaagtgatggttattatgtaaaagaaaaaataaatgaaaaagtaattatggattcaccggtacatagatatgatggatttgagtttagaatattatctgctgacgatgaatttgtacaagcgttaatctatgctgataatccttatacaacaagagtactgggcttaaatgttgataatgcagggaaaaaagttggagtgttgtttgatagtccggtattgattgaaacagatggtgggtttgcaggggtattgtgttcctatgtttttcaggttagcagacattatatagacgtgaataaaatgtatactttattaggagcagatattaaaagtagaaaactgatgatagaaagttatgctggattaagagacaaattgctggagcaaaagagaagaatggaattttctgaaatgatgcattacatggaacggaataaagatttgcagagccatactttgagaatggttgaacatacaaaattgtatcaggaaaattttgtgagtaaatatgaatcaatgaaagctggaagagtaagctgcgaagaaagtatgatgttaatagtagcaaaagcttatgcagaagaaggtaaacacgttgcagtactgaactctggaaatccagttgaaccgaatggtcagatatttaagggatcagatacagaagaagagaaaatttgtcgtgtaagtaatttgtatgaggcgctgatatcagaaaatacgagtgagtattatattttaaataaagagatatttgaaaaaaatcagttcaatagtatgtttttaggcacagatcgggtactatattcgcccgccgtaatggttatgaaagattatgttggatatcgaccatcttggggaatggctacggaagaatatagagagacaccttattttgttgatgtattaacctgttcggcacctttcttcagtggtttgggatatattcttccagatggagatttagaatatttgttaaaaagaagaatcagaaatatttttgaagttgcaatcgaaaatggcgtcgagacgtttattataggggcgtttggatgtggagattttcataaccctgccagtacagttgcaagagcatttaaaggtgttctttcggaaaaaaggtatgagagagcatttgaagatgtaatttttgtaattgaaagcaagggagaaaatcgttcggatatagaggcttttaagacaatataaaggagcaaaatttgacagggcagtttttaaattgcaaaatttttgcgtctaaaaacgaataaaaactgccgacgaaatctgacacatattgtaaaaatatactaaaaaaaggtacaattaaagcaataaaatggaaaaataaaacaaagaaggaggaaaagaggatgtattgtggaaattgcggaacacagaatgatgaccgtgcaatgttttgccagaattgtggagcaaagttagaaggaagagcaggaggtaatcaaaatcagcagtggcagcaaaatattgattatagttatcagaatgaaattcctgggcaggtttcaattcagggaaagaaaaaaggaaaattgaaaattctgataccggctatagcagtagtagctgttgtgttgattttggtatttagtttaactggaagaagagggtataaaaaaacagtagaaaattatgtgcagggggcgctggatggagatatagagaaagtagtcagtgtaataccagagggctatatggagtattacggtgtggacagatcaacagtaattgatatggttgaggaagcacttgatgatagtgggctctatgatttattagatgaagactgggaattcaactatgaaattggagatgcagaagatattaaaggagcggaattacaggaaataaaagatgattgcagtgacagtggagttaaggtatctgctgcaaaatcggtagatttaaaacttactgttacaacagaagatggaccagaatctgaaacggtttccattccacttataaaggtagggcgtaagtggtatatcaatattgaagaatttatgggattattttattaaaacctcatagcaaaagcgaatcatacgaaagtaaaattgagaaaagaggatgagtttatgcaaagaacaaaaattggaatttcagcaggattgttaggtgcaggaatttattttacaggattattcagtggttatttgataccgataattttgacgttctatgtactttggtttgaagagaatggatggttgagaagaacagcagtaaaagccgtttcagtcatgatattcttttctatgattacattatttgtaaatttgtttccggatttcttaggaattatcagtagttttgttggaacttttggtgttgaattttattattcttcagtaaatagtttatttgattccatagttaaattgattgatttaatgagaaatattttgattttaatattgggattcaaagcatttggacagagtacaatttatattccggttattgataatttactgagtaaatatatgcaataaaagagaagggacagcagaagaagcaattgtagtagatattctgggaacatttacaattagattagagttatcggatggtaaaggaaaaaagctttatagtgcaaaatttctctgtgaagtgccatgattccatactattttatctgttttcagagtttcaaagaatgatttcaatttatcattaagcctataatgttgaaactttatcagcatggtttaataaagacagaaaaacaaaggaggacaaatgatatgaagaaatcagaaaaggcaatgggtgtattaattggttttatatatgtggtactggcagggggttggattgcttcagggattcattataaaagttttgcattaatgttgatgcagacttcaaagattggaattgtgtattatgtgcttcctccggttgcaattgtatttcttgcaggaagcagtttatgtgagctggcaaaaaataaaagtattgccttaaacgctattatgggtatcatattatcgcttgcaatctttggagcagggatgtatagttattccagattaggatatggaacgagagattatgttttgtatacagcaagtgcatacttaattatttcggcagttacgattagtgtatcgtttattttaatgatgttgaattcggcaaagaaaaaaatgaaaacgaattagaaaagcagaaaatgaaaaagacgtatgagaaaatatttcaagtgcgtctttttttaaagaaaatcataaaaaatagagtaaatgaatatacagatgaaggaatttgttttaaaatagataataagaaaaaatgaacaggagtgattaacgatggcattttgggatgatttggaaaaaaaagcaaccgacgcaactacgaatgtaatgtctcgggtaaagggcgtgtcggatactacaagattaaattcaatggtagcagaagaagaaaagcgaatcaaagacatctattttaaaattggacagacttatgtagcgttacatggtcaggaaaatgatgctgcatttgtaaacctgcttaatgcgttaaaggcatcacagttaaaagtagaacagtataagcaggaaattatggatatcaaaggcgtacgcagatgtgaaaaatgtggtgcagaagttcagaatggagccgctttttgtatgtcttgcggaactcctcttccaaggattcagccacaaccggtgaatgttggaagaacatgtaagaagtgtggggcaaatttagcaccgggagctcgtttctgtacaaattgtggaacaccttatgcggaagaagcatcaggaagtccaagcggaaattctacaggaaattctacaggaagcgctatgggtagtgctatggggaattcatttggaagttcaaagcctgtagaacagccaaattatgaaccacagcaaagggaagaatcggattcttatcaagagccaatacagaaagaagaacagcttcaaaaacaatgggaaaatcctgcaaaaaaagtatgccaggcatgtggagcggaacttggtgaaaataccagattttgtattgtgtgtggggcaccagctggacaagcaccaaataacgcagaacaaccacaaaatataaccgtaacagtgtctccggttacacttagtaaaccagagacacaggcagtacaaagtgaaccggcaagaacgaagttctgtacaggatgtggtgcaccacttgaagatgattcccttttctgtaccgaatgtggaaaaaaggtagactaaaaaagagataaagtgataacctgcaggaagaaatttctgtgggttatttttatgtaatgaagctgcaaaaatactgccgataaaatctgacacacattgtagaagaaaatgaaaaaagttaaaattgtaacagaaaagaaaaagaaagggggattttaaaatgcagaagtcgagtaaagtactaaatataataataggagtgctgtatgctcttttgggaatcatatggcttatttcaggaatctcttctttaggaaatgtgcagattctattaggaacgaatatactgacatatgtgtgcttgttccttccggtattggtagtatttgctattattggtattagtttgtatcgtctgaagaaaaacgaaagtacaggattgcttgctttattatgggtaatcgcatctgttataatgttttttgtaggaattgttttatataagcagtatacatcagatggaacatactttgaaacattgttttatacgctggcattttattttgtggcagtagagttgactgttcctggtggaattattattatgatattaacagcaataaagaagaaaatagagcgttaaattaagattatggattacaatgaactgatatcttgttttcaagatacgataaaaatgtcagaagatgagcttcaggatgcaactttagaagcaattgacaatacctgtgtattaaaagaaaatatctatgaagaagtatttgaaaattcaaatgtcaaaatagaagaaagaccagaagatgcggatgtgtttgttgaagttaatacgacttttgcaacagcaaaggaatatttgcaggatggaaaagtagcagttttaaattttgcaaatccgatatgtcccggtggaggagtacaaaacggtgcaatcgctcaagaggaatgtttgtgccggagtagtaatttgtattgttgcttaagagaggaaaaggtctttgaagattattatctatatcatagaaagatggatcattatctgagtacagacagattaatctacagcaaagatataactgttttcaaaaatgacaacagaattccggcattaatgcctgccagaaactggtttcaggtagatgtcataacttgtgcagcgccttatctgattggaaatgtaaatattgaccagaattcattaaaacgggtctttttgaaacgaatacagaacattttagatgctgcaattttaaaccaggtagatacgattattctgggagcttttggatgtggagcatttaagaatcctccggaccttgtagcacaggctttttatgaagtgatttatgactgggattataaaaaatattttaaacgaatcgtgtttgcaattaaatctaccaatatgaagtgtagaaatattgaaatattttcaaaatattttataattaaatcagtttcagaagaatgtctgataggggataaacagtatttcaaacaatggcagaaaacaaatccgtattttggtaaaaagttttcagttctgggagattcaattagtacattagaaggttgtcatccacagggatataaagtgtttttcaaagatgagatatgtaaaagaacgggtgtcgtaaaagaaaccgatacctggtggggaaaagtaatttgtttttttggtggagagctattagtgaataactcctggtcgggaagcagagtgacaatggttcctgaaaattctgaattatttccttctgcatgtagtgatgaaagaacaggttttttacattgggatgaagaagtgccggatgtaattcttgtttatttgggaacgaatgactggggatttggtgcacttttatccagaagagataaaagaaaaaagaccagacctcaaatagcaaattattcaagatatcaggaatttgattatgcttatgataatatgcttaagaaattaagacgaaattatcaaagtgcagaaatctggtgttgtacattaggtgtaacggaaatgtcttcaaatccttattttgaatttccttatgaatattgtggaatgaatatagaagcctacaatggagtaatcaggaaaaaggcaaagaagcataagtgtaatataatagatttgtatgcagaaaatcaaccttatgataccatagatggcacacatccaaataaggatggtatgaatactttggcgaaaatgatagcatcaagtatgttatgaaaagataaaaaacaataaaaaataatagaagaaaagactggtgaaacctaaaaggattatgatagaaagcgcaatgtatgaattaaaacaagacttaaaactatatggaaaaccattattgttaacagcaatggtacttgtggcaatgcagttgatttttcatgagttatgtcctatgaagatacttttagggattccctgtccaggatgcgggttgactcatgcctgtctggatattttgacattccattggaaaaaggcatggaattggaatccggcaggatttttgtgggtaccgtctattcttcttttattgtggatgcgatatataaaacagcatagaataaaatatgtatttgtttttttctggtttacagtcggtatgacactgctgaattatgtgattaattttgggaacattattgcagagtataaggctttgtgataaaatttctataaaaaatattatatttttgtaaaaaacaaatgaggaggggatctcaatgagatgcagtaactgtggtggagagaatgagagcggcgtaaatttttgccagtactgtggagcaaaattagagcaggaatcaaatttctcccaaaacgattttgacaagggtcaggcaggacaaacaggatatgatccaaactatagcaatcaagcagaatacagcaatcaaacagattatagtaataatggaggatattcaggacaggcaggatattatcaattaacagaatctcagcttccggaagaatacagaccacttaccatgtggggatattttggatatcagttattattctgtgttccatgtgtaggatttatatttttgttaattattgcatttggcggaacaagaaatgttaaccttaaaaactttgcacgttcttatttctgtgtgtggattataatggtagtattaattcttctgttctcagtaatcggaggcggttttgcgacgttattcagtcttggatattgatattattaaaagtagaggggatgtcccctctatttttcttcctcttgacagtaatcctcttacctgctatgatgtcaacaaagcaattcttaaattcaaattcaaatatatctttttattcaaaaatttttccaagattgtaaataattcaaattttagaagctttttaatgatttcaagcctaagacttcctcgttatatgtaaaattccgttaaaaacagaataaaacctcgaaaaaaatgcaaaaagtgtgaaagttttgtgaccacaaagtttgacacatattggttatttgttgaaaatttattaaaatagatgacaaataatgatattattatacatttttcgcaggagggaaaggctatgaacaaaagatttgtaaaaagactgctggtgttctttaccgtgttatgtatgacaatggcaatgacagtgccggcactcgcagcaggcagtggaactaatgccacaacagatgacccggcaaacggtattcttcaggtaatgcttgcctatgttgatgatgggggtaacagaacttactttagtgccggaacttgttttatggttaatgaagagtatgttgtaaccaataaacatgtatttgatttggatacaacagattctgacggagtgacacttcgtgacacaatcgtagaaacaatgggactgaaaagtctgaaaacaaatgatactcacttgaagttatatgtatttacaaacagagatacaaacgtagaggcaactgtagatgcaaatgcacagagtgaagaactcgactttgcagcattaaaactttcaagaaaaatttccggaagacagccattagtacttggtgacagtgattctattaaaccacaggatactgtatttgctttaggttatccggcagattcaattcagaataaacagtctaatacaaaagaagatgtatctatcacaaatggtattatctctaaggtaactgtaacagacaacgttgatattattgagcacacagcttctcttaataatggtaattcaggtggaccgcttcttaatgcagataatgaagtaattggaattaacgaatttatcatagggcagaaaggatattccatccagatcaatcagattaaagatttgcttgatacttttgaaattgcatacacagacggagcaacaggtgcttccacttccacttctaactcaaatgatgcagaagagacagaagaaccagatgcttcaacagaagaagaaaccacaggtgaggcagaagaagagaaagcaacagaaccggatgcagaccttgtaacagcacttcagagtgaaattacaaaagctaaaaaaattgaccagaaaaattatacagaagagagcgcaaaagttcttgatgatacaattggttctgctgaaacagttgcagcaaataaaaaagcaacaaatgaccaggttacaactgcaacaaatgatttaaagacagcaattgataatctggaagaaaaatccggaccaaacatgattatgattgcaggtatcgcagcagcagttgtagtagttattattgtaatcgtagttattattgtagtatcaaatggcaagaagaaaaaagcagcaccggctcataacaatatgcagcgtccaaatacaccaccgactcgcccacagccagctccacagcagcagccacagtacagtccggttgaccagggtgattccggaacgacattattaaattctggttcaggcgaaaccacattattaaatggtggcggcggaagtgcttatcttatcagaagaaaaaatggtgagaaaattatgattacttctcagaactttgcaatcggaaaagaaagaagaagagtaaactattgtgtttctgataatacatccgtcagcagataccatgcaattattacgaaaaaaggttctgattattatgtggctgaccagaaatcaagtaactttacttatgtaaatggtgtacagttaagcccatatcaggaaacactgcttacagacagatccactctgaaattatcagatgaagaatttgaatttcatttatcatagttgctaaatgattaagaacagtgtaggtgaaaaagatgggatttttaagtgttttacatagtgatgtaggaataaaaaagaatacgaatcaagattctgtcttaattaaagtggcttctacagactacggcgaggtaatgcttgccgtggtctgtgatggaatgggcggccttgccaaaggtgaggtcgccagtgccgctttaattaaggctttttcagattggtttgaacaagaatttccagaaattttatacaacaaaagaaccgaaaatggaattgacagactggaactggaaaatgaaatgaatcagcttgtacttgaagttggcgaaagaatctccagatatggagagatgtctcacgtagcaatgggaacaacggtggcagtgcttctgatggcagaggggaaatatcatatcttaaatgtaggagattccagagtctataaactgaatgagactggattaaatcagcttacaaaagatcagacctttgttcagaaagaaatggaccagggaagaatgactcctgaagaagcaaaagtacatccacagagaaatgtactgctgcagtgtgttggagcaagtgaaattattattcctgagttttcacatggtgaatacaaaacaggagaagtctatatggtttgttccgatggatttcgtcacgtcattgcaaaagaagaatttgaaaaacttatggagccgaaaaaaatggatacagaaaaggcactcaaagatgttgccgtttactgtaccgaattaaataaatcgcgacaggagaaagataatatttcagtcattctcctgaaagtatgctaggggataaatgaatgctggaaataggatcgattattgatggtaaatataaaatattaaataaaatcggccagggtggaatgagcgtcgtttatctggccatgaatgaaagagcaaataaacagtgggcaattaaagaagtccgaaaagacggtgtgaaagattatgatgtcgtacgtcagggactgattgcggagacagacatcttaaaacgtctaaatcatccacatctgccaagtattatcgatgtcattgacagagatgataccttcctgattgttatggactacattgaaggaaagtctctggaccactggttgaaaaaggatggcgcacagccacaggaaaaggtagtggaatgggcaaaacagatttgcgatgtattaggttatcttcattccagaaaaccaccgattatttatcgtgatttgaagccggcgaatgtaatgctgaaaccggacggtcagattatgattatcgactttggaactgccagagagtttaaagagacaagtatagaagatacttcttgtcttggaacacagggatatgcagctccggaacagtatggcggtcatggacagaccgatgccagaacagatatttatacactgggagcaaccatgtatcatctgttgacaggacataatccaagtcttccaccgtatgaaatgtacccgatacgaagatggaatccagctttgtcatcaggtcttgaaaaaatcgtattgaaatgtactcagagaaacccaaatgaccgatatcaaaactgtgcagagcttatgtatgcactggaacattacggggaattagatagtgcatacagaagaaaacaatcaattaaatggaaatcctttgttgcgtcctgcgcattaactgttgtgtcattggcaggaagtatcggatttaaagtagcagaatcaaaaacaattaagaatagttatgatggatacatcagcgaagcaacaaaagtaaccacgcaggaagagcgtgcagattattatgaaaaagcaattaaaatagatccagaacgagaagaaggatatttagaattgcttgatctgtttgtctatggtgcggataaaaatgaacgtgattttaatcgtgacgaaacagcagagatgacagcaattcttggatataaaggaaccggaaacagaacaaacgaaagttattttgaaagaaataaagaaggatatgacgagtttgctttccgtatgggagtgtattacttctattattatgaaggaggcggaagcgcaggaaaatcgatggcacagccgtggtttgaaaaagcacaaaaaggaacaaccttagatgcagacaaattacagcttgcggaacgttttgcaaagatttccggatattatgcttctttagattcaagtgatgagaccggatatggaagttctgcttcttatggtgattattggacagaccttaccaatcttacagatggagatatcagcaaaatagttaacactaagactgctgttgcaatttacgaagaactcattgcacgtattaatgaaaatgcagttgatttcaaacgtgccggagttaccaaagaccagatgatggataaattgtccaacaccaaaacaagacttgaaatgcttcagaacgaaatttcacagagtgatgaaacctgggatgaagtattagatagtatcagtgcagcggaacatcaggtaagcgttgcattttccggaagagacacacagccggaacagaatcaggaagaaggaggaaatacgaatggaaagcagtgaaagactgattgagttatatcgtatgggctttattatttgtctgtgccttgcagccgtatttttactgctgagtatctttttctttttcaaattcagaatccgtgatgtgtttgatttcttaagtggaagagcagagaaaaaatcggttaagcagatggaagaaaaaaatgcgaagacaggaaagcttcgtgatgactattatgcagaaccgctgagttcagaactctataagacgccaagcggaaaagttgtgccgacgatgtatccgcagacagaaccaatgaataccggaacagagccgacacaagagacacagactaaaatgagtcagactccgacacagctatcatcaaatggaagcgaagagacgactttattaggaagcggacaagaagaaacaactctgcttggaaatggtgaaaccggtacagaagaaaccacacttcttggaaatcagaatcagaataaagaagaacaggaaataccgggctacaacggagagactgctcttttaactccagagatggaaaaagcaatacataaacaacaagaagagaaaaagcaggaagagaaagaaaaagaagtcagacgtaacaagtttgaaattataaaagaacagatagaaattcatacaaaggaagtaatctaaaattttgatagaaaaaataaggaaggagtgaaagatatgaaaaatccaaaaagaaatccagtggaaagattttgtgcattactgcttgcatttattatggtgtttacactggtactgccggatggggcattgagtgtatcggcggcaggaaataattcggatgaagcgttaggagaacctgaagcaagtaccgagaaaacaaccgatgttgaatttacgatttttgaaaatgttcctacgacagaaaatccagataacaaagttgcaattcaagctgcagatttgcagattaaagaggcaggcacagataatgtagttgcaaatggacaatctgatgcaaacggaaaagtgaaagttaaaaatctgacttatgatacagaaaaaagttatgaatatactgtatcaaaagcaggatatcaagcattagaaaacaaatccatatcaattggaacggtaaatgaagtcgaagttacattagaaatgagtgacattagtttaggagatttatcagctgtagaattatctccaaataaagaaggtgttccttctcaggttcaagcagttattaataacaaaattgataattttgaggttggaggagcagcacagtataaatgggaatcttccaatccagcagttgcagatgtagatggaaatggtttaatcactgctacaggaagaggaagtgcaacaattactgtatacagaaatggaaaaagtgctcagacaacgataaaagtaaaagaagttccgtcaatggaattgaatgtaactccaaatacaggaactgatgttaaaagtgttactatgacagtgactatgccaaaagatgcaaaaggcggaaaagtaacattttcattagaaagtggagaaagttatgaagttgctgttaatgaggaaggaattgcagaacaggttctggcgaaagatttaataggaaatgtgaaagtcagtgcagcgtattctggaaatgaactgtactttgagaatagtacagaagaaactggaaaatataaacaaaagaagcaaatttctctgacagctgatggtaagagtgaagcaagtattgattatggaagtgacttgccggtgctttctgtaggaaacgcagaagatagaacagtcacattttcatcttccagaccaaatgtaatagaagcaactccagatggtaaattaacggtaaaaggggaaggaactgctaaaattactgcaacagcagcagaaagtgataattatacagaatcaagtgcttcttttacaattggagttaatcaaaagccaattaataagaagattacatttgctgattttgaatggaatacaacaagtgcttctaaagtatatgataggagtagaaaaattagcattactggtactttaaaaagcgatgaattagtaggaaatgatcagattacagttacagtaaatgctcagttggaaaaatcagatgtaggaagttattctaaatttactgttatagatgatgattcagatattaacttaaaaggtacaaataattataagataacgacagacttctcaaataaaaatgttcagttagcagaaggtaaaacggttaatattactccaagaccagtttatgttaaggtggcagtaaaagaaggtaagacaacaaaatttgcgtacggaaaaagtaaagcatatttacagaaagctgtagaagaaaattatgaagtggtacttgcgggtaaatatgaagatggtaatatacttgagccggataaagatcagggactgcttccaccagctaaacttgaattaaaaaactatgcagaagtagcgttaaaaggttttaatgataatgatactgtgtattatgtaggaagttatacagcagaaataattcctgttataacaaacaaaaatgccggaaattatgaaattagagtagattctgaaaatattgcaaaatacagttcagatcttacgattgaaaaagaaacacagactagtttaaatgatttagttgaaattgttggtgcagatggaatttatcaaaatgagaaagatggttctgtatatataagaggaaatcaggcagcaacattaaaactgcaattcaaagaaacaaatgcatattatgaccagatctgggtttctaaaggtgaaaaacaggctgatggtcaggaaatttattacgatgccattaatagtggaatcagctttgatgatagcaaagataaagagtacactttgaaagtttccttaagaaatagtaaaaatgcattaacagtgacagatggtgttgaatatcagaagataacagtagatgccaccagtccgacagctgattttaaagacttaggaaatgcaggacagtttaataaagtacttccaaacgactggaaaggctttgggaatttttcaaaggataagacaaaagaatatcttgttacttctgatgatgctaccagtaaagtaaagagtcttaaaacctgtaaaattacagtggataatgatgaggcagaagcaattgtagagaagatttcagaagcagttaagaatgatagtgtatgggaagaaacaagtagtgtaaaattcgataaggaaggaaactatattgtacttgcacttgtagaagataatgttggaaataaagcggtttatgcatcaaatggtttggggtttgatttaactgcgccagatgtttcggtcaaaattattgaaccagaagaaaacactggatataatcaaaaagttaattttacagtagagataaatgataaagatattacgtctggtgttgatgaaattgaagttatagctatggattcagataaagatgtgactgatgaatatatagaaactgtaaaagtagcaggtggatttgatgaagataataaaatagttatcgactcttgtacacttaattcagagaaaataaatacaattgttgaaagtgaacaggatggaacacttaaatcaattcaagcccatgcgaattttactgttaatggaaaattgtctatcaataaatatcagtcaggatatgcaattgtaaaagtaattgtacgtgataaagccggaaatagtaaagcgataacaacaaaaagagaaaaggtagatgtagttgcgccaaaagtaactgtgaaatatgataaggattcggaaacttcttatattcagagttcagaacgaacaatgacaattacttatacggaaagaaactttattgaatcgggattaaggtttgatgtttcaattaatggaacagaaccagatgttcttacgcttaatgaattagaggatcttgaatgtgtaaaagaagtaaaaaaacctgttaattcaaaaaatgagccggatgactatacagacgaaagaacaaatacttatgaaattacgttttcaggtgatggggcatataaagtgattccgtatataaaagatgctgctggaaatgaaaatcaaggtattgaatatgcggatattaattcaaaagcaaatgaactgttcattttggataatacagcaccaacagtagatgtgaagtattcaccagaaaaaagtgttagagaaaacgaatattttaattcaaaaagaacaatgacacttactattacagaacgtaattttgataaaagtacattgaagtttgatttgatatctgatggtgaaacaaaagcagggttaacaaaagaagaacttataaagaatggcttagttataacaacaaaagatacagagtcaaaatttaatgaggaacagcatactgatgatagaaacatagtttatgaaattgaatttaaaaatgatggtttttatcagttaattccttatttaacagaccttgctggaaatgaatatgagggtttagctgaaagtgaaataacaaaatatcaagaattctgcatagataagaataagaaagcacctaaagtaacagttaagtataatgataatgataacaaactgaaattgcataatggtaagtatttcaatcagcagagaattgcagaagtaacaatcaaagagcgtaattttaatgcggatgatttagagtttactttaactagagatggagataagcaaacatataagggattttctgcattagagcaggcaattggtaagttgaaggattgtgatattacagaaattaaagacagtgaagaaaaaactgcaaaacaaaagcatacagatgaaagagaacatacattttctatcacatttggtaaagagaaagaggatcatgactataaaatttctgtaaaggcaacggatcttgctggtaataataatgatacagttaaagatgagaatataggggctgagacggttgcaacaggagaagagtttactgttgatatgctggcaccaactttgacagttaaatattatgtatatcaagatgaaaatggtaatgaatcagatgagaagaatgaaattgaaaaagatgagattgattctggagagtgttataaaaatgcatctattcatgcagaagtaataattgatgaacgtaacttttctgaagaaaaaaatggaaaagatagttttgcagagaaccagataaagcttgactattctgctaagacctatgatggaactgaagttaaaacaaccgattttggtgatgtagctaaagagagagaaaattggaagcctaaccaagagaataggaaagataatattgaaatgctcaatttagaattttctgaagatgcaaattatactttaagcattacatacaaagatcttgcgggtaattctatagatcctatgagttataagtctcagtttactgtggataaaactgcaccaactggaaagattcagataggcaaagatgaaaaagatgtaggaattattggaaaagtttttgattttatatattcatttttcacgaataataataaaacagagattactatggtaggaacagatacaatgtcaccaatagtagaacagaaatattatattgagaaaaatagagatataaaaaatggtaatacgggttatgaaagattaagcctagaagaactaattggtaaaaaagaatgggttgatacaaaaacaatagaagaaaataaagaaaatatagctacaagtacatttaaaatattagaagaaaactctaaggcaatcccatatctatatataaaagataaggctggaaatgaaacttacgtaacatctgatggtgcgatttacgatgatgaaaaagaaggaactcctgaaattcaaattacgacagatgatccaatatcttgggaaggcgaaaagaatgatataggtctttttaataagaatgtaacttttaatattgtggtaactgacccaaaagtaaataaaacttattcaggtatcaataatgtttcttatagaatttataaaaatggtgaatccgaagatgtaaaatatatttctctttataatgaaactatggacgaaccgataatgaaacaagtttttacttctgaagacttagtagttccatcagaaaagtttaacagcaatgatgttacaattgaagtaactgctacagataatgcgggaaatactgaaacagtaacaaaacaaattgccatcgataccacctcgccagaaattacagtttcctatgacaacaacactgtcgcaaatggtaaatacttcaaagcagatcgtactatgacaattgagtacaaagaaagaaactttgatgaaaagggacttacgtttgatgtatcaacaaatggtagtttattacagggaatttcattagacgaattaaagaaacttaaggataagggaattatcgtacaatcatttaatgctgctgatgatgatactgaatcgggtaaaaactttaaggattttacagatgaacgagttaatacttataaaattctctttaatgccggtggcaataacggagatatggattactcgattgttccgcacataatcgataaagctaataataagcagaataaagagacacagtataaagctggtacagaagctaaaacagaattcaccatcgataaaaaagccccagtcatctccatggcttacagtgcagagggtgaaacaatcaacccaggcggaaatgaagtttccagagtttacagaaacaaaacaattacagcgacagctaccattgaagaacgtaacttctccaatagtaatagtttttcagaagatccgaaacaaatgaacctcacctatagtgcaaagaacttccaaggttccgacatcaacaccgagaactacacaggcacagcaaacacaagaggtgaatggagtaccaacgtttacaccagaacaaaaaccttcacattctctcaagatgccaactacaccttaggtcttgtttacagagaccttgccggtaacgaagcagtctacgatacacgttacttcacagtagataaaactgctccaaccggaagcatgaccatcgaggataacagtggaacagccaagacctggattcagtggattcagcaggtattcttcgatatcttcacccagagccagaagggtgtatccatgacaagtgcggatgaaacagcaggtgtagcaagtacacagtactacaagtatcatccggattcagagagccgtcatacttttgacggtttatcaacacagaacttggattctatcagcagctggtctgatggatacagtacatctgttaatgcagatgaacaggttattgtatatgaaaagattacagaccgtgcaggaaatgtaacttacattaataaccaggaaggtgttatcgcagataatacttcaccgactgcaccggaaattaagattacggcagcagaacctgctcagggaatctacaatgcaagtgttccatttacaattgatgtaacagaccctgaaaatggtggaacttatgccggattaaaagaagtttcttatgaaattacaaacaacggcaaagtaacacagagtggtaactataacagtgatttatctgacccgacagcgagagtacataacattcatcgttctgaaacagtaaatgcagaactcaataacagcaaccatgtaacaatcaaggtaaaagctgtagactatgcaggaaatcagtcagaggcaaccaaggatttgaagattgatattacacatccggaagttacaatcacatttgacttaaataatccgctgaatggcaagtattataagacaacaagaacagctaccgtttctgtaaaagaacgtaactttgatactaacgcagttgatttgaagattacgaatacagacggaacaatgccttctgtaagtggatggagtatcagttctcaggctggtgaatccgatgatgcaattaatacctgtcgtgttgagttttcagcagatggtgattacaacatgacaatgcagtgtaaagaccaggcaggaaatgaatcaaatacagtaaaagtggatgagtttaccattgataaaaccattccggttatttctgtatcttatgataataattccgcagcgacaccgggatattacaatgcaaacagaacagcaacgattacaattaaagagcataactttaatgcagcagaagttaattcacagattacagcggctcttcagggaagtggtatttccgcaccgggcgttggaggctggagtaacagtggagatactcataccgcaagtgttaccttctcagatgatggagattatacctttgatattgactatacagaccttgccggaaatgcagcagcagattatacacaggacagtttcactgtggataagacaaaaccggaagtagagttctttgatatcgaagataaatcagcaaacaatggagttgtagcaccgggtgtgaagtatagtgatgtgaactatcttgaaagtggcgtagagattaagattgagggtgcagagcatgaatctaaagaactcaccggaagccgttccagtatcgcaaacggtgaaagtattaagatgaatgactttgagtatacacaggataatgatgatgtttacacaatgaccgcagtaatctcagataaggcaggaaacaagacagagaagaagattatgttctctgtaaacagatttggttcgaactattcgttctcagatacaacaaaagaattccttgatgaggtatattctaattcagcaaaagaccttgttatcacagaaaccaatgtcgattcactggtatttaacggaatttcttacagtctggataataagacaacagaactgaaacagggaacagattataccgtgaaagaaaccggaggcgaaggttcctggaaacagtatacttacacaattaagaaagagaactttgaaaaagaaggacgttacagtgtaacaattgattcagaggataaggcaacaaatacaatgaataacaaagtaaaagaacgtaacattaactttgttattgataagactcctccaactgttgttatcacaggtattgaggaatccagctatcgtgcagacagcagagatatgtcagtcaatgtatccgataataccgctgtaaaacgtctcgacatcatggtagacggaaaatctgtagcaacctatagtcaggaagatgtaaaagaagccggaggcaaaattgtttatacattgaacagctcaaacagcaaacagaaagtaaaagctgttgcggttgatatggcggacaatgaagcaacttctgataatcataatatcctgattacaaccaatctgtttattcagtatattaataataaacctcttttcataggttctattatagcgttagtgctgattgcaggtggtgcaatttacttctttgtatttagaagaaaaaaatctgaagatgcagcagatgcaaattaattagaaaggatggctgtctgaatagaaatatttgggcagccaactttttaaccagagtatgtattttgggcgtctgtcttaaagaatttaagacaggctccgagagtacatcaaagaaatttcacgaagataaaagaggatttggcggggaggtgatttgatatgcttcaaaatggagaaatacttggcgggatgtatcaggtcattggtgaaattggtaaaggtggttctggaattatttacctgggatatcacttacgacttcaaaagcagattgtgattaagaagattaaagatatcaatgtcggacagattaacaccagaatagaagcggatattttaaagaaacttcatcatagatatcttccgcaagtgtatgattttttagagatgcaggatggaatctataccattattgattatattccggggcatgatttgagttattatctggggcgaaactataatttcccggaagaaacaattttaaagtggatgcatcagatgtgtgaagtgttggagtatcttcattctcagaaaccaccgattcttcatagcgatatcaaaccgggaaatattatggttacggaaaatgatgatatttgtctgattgattttaacgtttctttggatggtgaagtatcaaaggagcttcagggattgagcagaagttatgctgctccggaacagtttcaatatgccctggatagaatgtatggaaaacacagcaaaatagtattagatgcacggatggatatttatagtatgggggctgtgttctatcgactgatgacggggtggacgccagatgcagaatcaggaatgccatattctattatggagatgaatcttccctacaataatggaatcaaagcagtgataaacagggcaacggcatgggaaccatcacatagatttcagtcagcaaagcaaatgagaaaggctttggacaatgtggaaagaatggacccacagtacaaggcattaacgaatctgcagattcttacagcttttggaagtggtttgttgatgctttttggtatctttttaatcttgtttggaacaatgtcaaataaaaaagaaaaatggcaggaagcttatgattctttttatgaaattacagaatccggcacagattccgaggttgtcacagagggaattgatttgcttaataatggttccgtacagggggcactaaaaaaatatccagagaaaaaggcggagattcttcatgcaatcggggatagttatttcagacaaaagcagtatgaagatgcaatcgattattataaagaggcacttgatacaggagaagtccaggaaaattatttaagagattatatgatggcgctggcaagaagcgggcaaaatgtagaacagtcagtgattgaaatagaatatccggaagcagcctatatggagcgggcagatgtggagttgatagaggcgcagacaaagtatacacagggtgagtttgaggaagcgctaataaagtgtgaagatgcattagcacaaagtacggatatagaagtcagcagtctgatttgtgtcttagagtcagaaatctatacggagcaggaagagtatacgaaggcggcagattcagcaatacgagtcaccaaatttgattcatccaaagatgcaagaagacgagcaggaagtcttgcttttgaagcgggaaatcacttagaagatacgaaagaaaaaaatgggtggtatgagaaagccaggaaatattatgaaacgctttgtcaggatgagacgtgttcgtatgaagatgaaatgaattacgcactggtacttcaggctctggagcagtattcggacagtaatgtctgtttaagaaagatgagagaagaatatccggatgattataaggtactgatgtggatgtgctataactatctgggaatcggaaatcaaaagggcagtatggctgaggtggaatctgatttgaattttgcatatagttcctgtaaatatttatattctcaagatgaaagtatgacaggtggttcagatgaggatatggaaaaattaaatgagttgatgaagcagttggaagaataataaaaatacaggaggaaattatggcaggaaacgttatgatagttgcaggcggcatactgatagtcgcagcaatcagtattatggttggtgtgaatatagtgttatcacgaaaaaaaaggcggataaaggaacagatttattccatgtatgagtaaagaacaaagaaaataaaaggatgagggaggacagcaaatgaagaaaaaaggttatatcatattgagcgtgatttgtgcagttgttttaattgcaacaggaattattctgggtgtagttatgaaaaagcagtcaaataaaaaaacatatacggcttcgattaaaacagcggaaaaatatctggaagcgggtgattatacacaggcggttgtagcatataaaactgcaatcgaaaaaatgccggaaaaagaaactggttatgtaggacttgcaaatacctatctggaacagggggatacttcttctgcaaaaattatcttgaaaaaaggttatctggtcacaaactcttccaaaattcaatatatgttgaatggaatcgaagatggaagtctgcttgtgaacaatctgaaagaaacacctaagaaagaaacgctccaaaagagtggagaattatcatttaatcaaaattttttccaaaagttagagagttttacctatcaggattatgaaagagaatatggtggacttccggaaattgtaaaagtaaaaaatggagaagttgaagtggtacataaaaatctttctgcaacttgtttttatgcaaatacctcagaacatggagatgtagttgatacaaaaactgatacaccggataaaaccggtatgccggaaaaaattgtagtggatgatatttctttattattcaagaattttacaggagaaattacaattgatgaacttcagagcatttgcggttccaaagtagatattgtgaataaaaaagagcgcagttatgtggaatttgagtctggaagtgctttgattcgaattgaaagcgatgaaaatggaacaatttcctcatctacggcatggaatgagattatccttacaaatgcgaataaaaaccggacagctaagaaaagtgtattttctggaattgtattaaatgcaatgacaagtgagggtgtagaggctgcaaatattagtttagaagcgcagggagattccagtcattcagcgaatataaagacggaaatggatggttcattttcaattgaattagaagcggatacctataatattactatcagtgcagaaaattatgaagaggaaacatttgaatttacaatagaagaaaatagtaactacagtggagagcagtttacgatttcaccaagtctggcaagtggaagtgcacgtatcgtgcttgaatggggagattatccggaagatttggattcttacttgataggtacgacggacgatggaacagaagtggatgttagtttccacaatgaccaatgtacaaaaaatggagaagtaattgcagaattagacgtagatgaaatggatggtcatggaccggaaacgattaccttaaataatttaaacggaacgtatcggtatttagtagatgattttacagaatcaggcaaattgcaagagtatggtgcgactgtaaaagtctatatttcaggtaagagtcagccggaagtgattacgatagctccagatgcaggtgtaaaaaacgtttgggaagtatttgaacttgaccatgggaaacttaatattttgaatcgtgcagcagtagaggattatgaataaagaggcttagtttatgtggatggtattggttatgctgattattgcactggcattatcagggatttttctgtggattaaatacagcataaaaaaatcagaggaaaagaaatattatgatgcggcagcgaggatgattaaagaaaattgtctgaataaaatcatacaaaaccgtgggcagagaaggcagacagtgacagataaattaatgatttatatcagcatatcaggaaagtccagacagggatttgtatttgacccggagaatgggattcgtattggaagaaacattgaggaaaatgaaatctgtattcgagatgcacttgtttcaagcagtcattgtaatatctacctgtatcaggggcagccgattatacaggattttaattcagcaaatggaacatttatcaagagaggattattcgataaacatccggttgatggatgggaatatatctattcgggagatacgctgttgataggggatacgaggatacagattaagtttttcttatttgatatgatgagattataaaagcaggaggacgacagaggtgatattgttaatttacaatcagaaaatgtgcagggagattcttttgcctaatcttcgagattctgattatgcgataagcatatctggaaaagcatatggattacgacaggatatccgactgcttttggagattacgggggttacctggaaaataaaagcagatgaaacttatcagttgcgaaaatcgggaatattttgtgaaaatgtggttcttgaagaacatgaaaagtttgtaatcaggacaaaacgaggagaagagctggagttgattgtggcagattcgggattgggctttttgacgttaggaaaatatgattttcgtcagatgagtcagatttcaatcggagctgcgccgcaaaacgaaatttgttatgagtttgaaaatttgatttcctcttatcacgcagaatttcagagacattcggacggctggtatgtggtggataaaagttcaaatggagtttttggaaagaatggaagaatcggtggaacctacagacttaattttggagagcatcttaatttatttggacttcatattatttttcttggaacgatgcttgctgttggtacctattatggtgaattgaaaatcgatcaggagcgattaaagcgatacgattttaagaatcaggaaaataatataccgtcaaacaaaacggatacggaagaaacggatacctattttaatcgttctcccagagatttttcctctttgtatacggaaccggttgagatagagggacctcctgccagaaaagcagcaaaacaaaagccctggtttttagttgtgggaccatcatttacaatggcaattccaatgcttttagggtgcggtcttgcaatctggggttccggaatgagaggaatggcatcgggagcttttatgtataccggtttgattacggcagttggttcttccggacttggtgctttttgggcggtaacaaatctgaaatatgcaaaacaggaagaaagcagtgaagaagaaaggcgtttcaatgcctatagcaattatttaattgatattacagaaacaattgaaaaaaagtataaatacaatgcagacatcatgcggaaaatgtatccggaagcgcagacttgtgccggatatgacagttctaatattcatctttggaatcgaaattacacgcatgaagattttctctttcacagacttgggcttggagaacttccatttcaggtgaaaattgatgttccgaaagaaaaatttacaatggatacggatactttgattgaaaaaccacagatgatacagaagcaatttgaaactttatatcaggttccggtaggaatttctcttttgaaaaaacagttgattggtttaattggaggaggaaataaaagaggagcgattgaaatcatgcattccattgttgcggaaatagcggcttctcactgttatacagatgtgaagtttgtttttctttatgatgaggaagaagacgataaaaaagtatgggaatctatgaaatggtttcctcatgtgtggtcagaagaccggcagatgcgatatatggcagcagatgaagtagaaagaagagatgtcttgtttgcattatccaatattttaagggcaaggatacaagatattgataatcggaaaaaaagagcaattccaaaaccatattatctgatttttgtttcaaatccagcactcttagagggagaacttctggcgagatatatttatgaaccggtaccggattatggaattacgacatttttaatggcgcagacagtctcacagcttccgaatacctgtgaagaaatgatacaaagtgataagacatttgaaggatattataatcttcaggaaggtccgatgcagagaaaaccgattcgtttagaccgtgtttccaatgacagtctggagcaaatggggcgcaggctgtctggaattaaggtaaacgaaatagaaacaacaagtgagattcctcagagtctggatttcttttcaatgtatggagtgcgaaagctggatgactttatagtggaagagcgttggaagaaaaacagaacttataacagtatgaaggcattaattggaaagaaatccggaaatgcagactgttatctggatattcatgaaaagtatcatggaccgcatggtttgattgcaggaactacaggttctggtaagagtgaaactttacagacttatattctttcgctggcattgaattttagcccggaagatgtatcatttttcatcattgactttaaaggtggaggaatggctaacttgtttgatggtcttcctcatatggcaggacagatttcaaacctttcaggaaatcaaatacgaagagcaatgatttcgattaagagtgagaatctgcgccgtcagagaatttttacggaaaatggtgtaaacaatattaatctttataccagattgtataaaaataaagaagcacaagagccggttccacatttatttattattattgatgaatttgcagaactcaaaaaagaggaaccggacttcatgcgtgagttaattagtgtagctcaggtaggacgaagtctgggagtgcatttgattttggcaacacagaagccgagcggaactgtagatgataacatctggagtaattcaagattccgattgtgtctgcgtgtacaggacaggcaggatagtaatgatatgcttcataagccggatgctgcatttatcacacagacagggcgtggttatcttcaggtgggcagtgatgaaatttatgaattattccagtccggatggagtggtgcaccttatgaagagagtgaggatggcgcagatgtatcggtatccatgcttaccagaacgggaaaagaggcacttgctgcaagtcgtcttagacgtttaagaaaagaagttaataaaagggatacgcaggaaaagacgcagctttcggcaattgtagaatatttaaaattaaaagcagaagaactgggctatcaaaatgcaaggcagctttggatgccggttttagagaaaaatattgtgttatcagaactggaaacagcagatagatcagctttggataaaggtgagaaatggagtctcgatgcggtagttggtttatatgatgatccgcagaatcagcagcagaagcctcttttagttgattttgcacagaatggaaatcttgcggtatgtggttctgttgtgacaggaaaaagtatctttatgcagacgatgctgtattcactgtttcaaaaatataatccggatcaattgcagtgttatatattggatttcagcagtcatttaatgactccgtttgaatcagcaccgaatacaggtggaattgtatatgacaatcaggaagaccggcttggcaaatttatgcatcttcttgagaaaatgatggaagagcgaaagaagctgtttgagggaggaaactatgcacagtatgttcgggcttatggacagaaaattccggcaattcttgtagtgattgacaattttggaggttttcgtgagaagacacggatgaaatatgatgatattattctcaaatatgtaagagaaggtaccggatatggaatgtatctggcagttacggcagcaggatatggaatggcggagataccgggaagaattgcagataatatacggactccaatctgcctggaacaaagtgatagattccgatatatggaaattttaagaacaacaaaacttccggtgtttccggaagccggaataccggggcgtggactggcagaagtagacggaaagatgttggaatttcaaactgcattatcggttcaggcagatgatgattttggaaggggcaggattttggaacaattcagcaaagaaaaatcagctaagtggactggaaaaagaccacttccaatacctgaaattccggaaaatccaattcttggtcagttggaaaaaatggagaattattcaacactggcagagggaagaaatcatattccatttgcttatgaattagaaacagcagaagtatttagcgtaggacttagagaaacctattgttatacaatatcaggacgtgcacatacaggaaaaacaaacgtattaaaactcttaatgtatggagcacagaaagcgggcggaaagctatgtgtaattgaaccgggacagaccgaactaaagaaaacagcacaggaatgtggagcgcaatatcttacagataccaagacggtatttgaatattttaaagaactgacaccgacgtttgtagcaaggaacaagaaaaaacgggcattgatagaggaaggggcagatgaagaaagaatttacagagaaatgtattcagaaactccggtctatatctttttaagtgatttgaaagagttctttaaattgatttacagtgctgatgcagaagtcggaaacatgtctggatttatggagacaattatggcaaagggaccgcttcacagaatttatttctttggatgcctgaaagtagaagatgcaatatctttgatgtcttataaagcatatcaatcttatatttcttataaaaagggaatccatttaggtggaaatttaagtacgcagaaaatatttaatttccagaatataccttatgcagagctttccaaagcaatgaaaaaagggtttgcttatgcggcagatgaagaagatgaaacaataggaattcagatcgttgtacctcttgcaaggagggaaaacatttgattggaatgttgatttcatcaatgtcagagaaagaaaccggatatatctgtgtgcgggcaaaagatatgatgggaagtatgagcgatgaaatgcttgaaatacataaatgccagacgatagagatgctgaaagagcttgttgagtctggtgagaaagcagatttagcctgtattgacattacaattccagaagcattagaacttactaaattatttagaagtaaaaatgaaacggcatatatcatattgattgcaagccttaaaatttctccggttacttatatgaagccgtctattcgtgctgaatccttgattttaaaaccgtttcagtcacaacaggtagatatggcagtgaaagaagcaattcaggaagtgcttaaaaagtatcagaatccagatatagataaggtgtttgttgtagataatcaagaaggcagagttttaattgaatacagtgcaatttattttttcgaagcaagaaataaaaaaatctatttgaatacaggagcaagagagtatggattttacagcacaatcgagcagcttcaagaggaattaggggaacagtttatcagatgtcatagaggatttcttgtaaaccagaaaaagattgaacgagtaatattttcaaagaatttgattcttttagcggatggatatgagattccggtttcacgtacgtataaatcaattttaaaagaatttcgtacgagtgtttgataaagaggagaaaaatgtctgaatatgagtatgcagaaagtggagttttgctgacttttcgggagcttactttgcttcttcaaagtgtgggagtaagatacataaacggtttttgtctgtcggagtctgaaatttccgatgaagaagtaattcaactgataggaagtctggttcgaaaagggattctaaagacttctgacacagaattttatatggaagatatggttgaaaaaatgattcgctgtattgggtggcctgatgaagattatgaaattgaacaggaaaatggacagatttattgttatgaaaaagaagaatatgcattggttacaaaaatctatccggtgagagagaaaactctggaacttattttatatagtaaagaagagtttcaacagaaaatcagaaaggaggaaattttgtgatactggtggatgttgaagtgcctgtgatgggaaagacttatgatgttcaaattgatgaaactgttccggtaaaagagattgcagggcagataagagatatgatttgtctacaggaacaatgtggaatcctgggcgggcaggaaaatctgactttatgggatgttcaaaggcagcaatgtctgatgggagaacatacagcaaaagaatatgaaattacaaccgggacaaggcttatgttggtataaacatggttattggtcagaaaatcgtgtcattcgtcagagatgtgtaacaaaaatagaaatcagtgataggataacattaacaacaacaaagagaaaaaaataagaaaaattggaggtagaaacatgggacagatggtaattggaaccacagaattaaaaaataaaattgaagagcttcgtgcattaaatacccagtttaaaagtgcagtaagtgagttggaaaatacagaaggtgctttaaatggaatgtgggaaggcgatgcaaaaaatacttttcataacgcatttatgagtgataaacagcagatggataatttctattccacaattgagttatatgcacagaagctggaagtgattcttgcaaaatatgtgcagggagagcagaaaaatattgagattgcaaatcagagaaagtacaaataaattttgaagaccaacattgagaatacatataaaaaacaggaggaaccattatggatggaatgattaaagtatcaccggaattattaatttcaacagcaggagaattttcaaatcagggaacaacaataaatacactgacaggagaaatgctgcagcttgcaacagggcttgcttctgcatggcagggagacggagcaactgcttatatcacaaaatttaagggattagaaaattcaattcagcttatggttcgcatgattcaggagcatgcaactgatttggaagaaatggcaaaagtatatcaggaaagtgataaagctgcagcggacgaagcaagtggtcttgttactgatgtaattcaataatgaaataatgataaaggctcagaggaaaagaaaaagtgattagaattgaaatagaaacgatgaaaactgctgtctctgagttacaaagaaaaagagccattctctcgaatataaaagagagaatggctaaactggcttatgcagtcagtcagcaatcttacgtggaagaaacggtatgtgagttaagaaaactgaaaaagcggatgggagaaattgaagaaaatctgagagatttacaagaagctcttgaagaaatttgtattttgatagaaaaaacagaagaaaaagtggtttcatattatgaagaagaacaacagaaacctcaatttacaagatttacaattcgatataatcaagagttgctgttaaatccgcatatacaggaacttgcacctatcaggctcaaaaatgaaggggaagcagatgagtaaagtaatagaaattgatacaaatgcattaaattcagataagagcagtatgtcagaagaattgcagcagatacaaaatgaattgaagtcactccaggacgaaatggagacaatgaatagctggtttaccggaccggcagctgcagcgtatcaaagtcatatggaagaagaaattgaaaacgcaatgagtgtatgtacttatcttacagagtatatgaactgcatagaacaggcttcaagagcttatacagagtgtgaacaatcagttgcaggtgtggtaaacagaatcagaatttaaggagagaagcaaatgagcgatgttcaggatattttgattaaagtagagccagagaaactggaagcgttagccggaagagtaaattcaaaaattaaggcaatcaggggacggtttgagcgaattgaatcagaggtaaataactcgaatcattactggaaaggcgagggaggagagactcaccgaagagtttaccaacagtcgaaagaaggaatcgaagaaagtctggaaaattttaaaggaatggtatctgcattggaaacaatggcaggaacttatagaagtacagaaacggaagtgataagttcggcagatggactcccagcagacgtaattatatagggaggatgaaaaatgggattattgaaatttgattttaataaagcgaacgcacaaattcaggaattagaagaaattgcatccgaaatagatcagctggcagctacagactatgagaaccttatgcaacaaatgcgtagtgcatggaaaggaagtgcggcagatgcttatataagaaaggcaagtcaagtgcaggagagaataaaaaatacatcacgggatattaaaaaaacttcggaagtctatgccaatgcagtgaaaagagtacaggcagcagaggaaaaagtcaaagaaatcgcaaaaggaaaaagctgaggttaacagtacatggaaatacttgtattgattatatgtgcagtaataattgtagcggggattgtgttgattatctggattttgagaaatcgttatgataacagcaatgtagtaatacacggtgggatggatacaggaacacaaaaaaacggaacagaatcagggagtttatttattggagtttcaaatgaacttggaacttctgtactaaatggaaaaaacagaagaagaacgtaccgtttttatttaatagatatggaaaaaggcgaaaaatatgatatacaatttcgtgagaatataggaattggaagagcagaaaatgtaagaggaattgaacgttttcttacaattcataatgacatgagaatatcaggatatcattgtaggatttatgcatttaacagtcagatttatattgaagataccggttcaaagaatcatacttatgtgaatcaggagcaggtgacaagacctcatgttttaagaaataatgacgtaataagaataggggatacaaggctgacagtaaaattttagaggtgctgaatatgaagaaaacaatattagcaacaatgatagcagtctttttgatttttgaagggagcgggtgtggaatgataaaaccagtatcgacacaggaaaaaattctttctgtgatgaaagaaaaatatggagaagaatttgaatttgaaggatgggcgcataaacagtatggaagccgtgatatgacagccaatgttacctgtgcttcatttccaggagaaagaatacaggcaggtcaggaagaaaatgaagaaggaaagatgatttactttgatgattacatggcttatcaaaatgaaggagagatgcagacaatacttgagaatttagtacaagaagtatatccgaatgcacgtgtaatctggaaaatcagttcttcggtgtttcccagagaaatgtctccgggaatgagtgtcaaggaaataatggaaagtaaagaatcggtattttctgcttatattgtagtaaatcaggcggtaaatgaagaagaaaaatattatgatttggagaaattaagagaattattagaagaaaacaaaattcgtatgaagggtgcattgttttttgctttagatgaagaagcatataaagcgctggatggagagaattactcttattgggcatcaaaggatggctggtttgagcagaggtgtaattttgcaattgatcaggcatatgaattttattatgcaaattggaggtaagagatgggaaatgcaaatgaaacgtattctgctatttttgacctctttacttattggggttattcaatggaagcggaacctggaaaaacattaggagagatattacaggaagctttagataccgggaattcgagtgaagtttattatcagactttaaatgatgcaattaaacgttatccggagcttgcaaatgcagaatttaagagtcccagctggcagcagggaggacggtatcattcagaaacttacgcttgtgtctttgaattaccaaatggagataattatattgcataccggggtacagatgatggtggatggattgataatggacagggcatgactcaggaatcaactttattgcagagagaagcgtcagattattttgatcagatggcagagcaatatggatggacagaatcggataatatttatgtgacaggacattctaagggtggaaataaagcacagtatgttacattgatgtccaatcatgcaaatctggtggatgaatgtcattcttttgacggacagggattttcagatgaagcaattcagagctttaaagagaagtacggagaagaaggatatcaggaagttctgaaaaaaatgtatgggtacaatggagcaaatgattacgtaaatccgttggggaatactatcattccaaaagaaaatatcaagtatatagatacggttccaaatccaggtagtgggtttgataagtttgcaggcttacatatggaagagcagatgtttcagagggatgaaaatggaaatgcgatagcagttttaggagaagaaacagagcagggagtgatggggaaattctcagctttcttatccgaatttttgatgagtttatcaccggaagaaagagatgctgctgcaatgtttgtgatgcagtttatggaattaagagatgtgggtgaaggtggtggagcattaggagtagatggaacttcgctgacatcgggtgatatctacctgtttattgagagagtattaccgaaactgctagatgcgatgctggaggaagtactggaaaaattcggtcttgataaagaggcggcagagcgtttaattcttttggtaaaattatggatgatttttgcatcaggaaaatgggagtataagttagtcaaagcattgattgacgaattgaaagaacggttattagagttagggcatggatatgagctggcagcgaaagcattagattctcttgaaaaatggattaaagaaaaaatagaattgattaagagctggttccagaagcaaaatgacagctcagactacagtagtttttatgttgaaaccagccagttgttacatttcaaagaagaattagcacagaaaaaaacacagctggaggaaaaagcaaatcaaatccgtgaaattcgaaaaagggttgatttcggaaatataacacagcagtatatttattactgcttggtatcatctgccagaaatcttgaaaatgaggcaaaagcagttaatagattgagtaaaggacttcaaaattgtgtgaaagtttataaacaaaatgagcaaaaggtaataggaatttatggaaaatgtggtggatgatttcacaaaaatcacaacaaaaaatgtcaaaaccctcttctaaatctaacttttttcctttaaaatggcaatcaaatggttgacgttatatggaaaagagggatgctatgacaacttcagaccttgtaaagcagatgtgtcaggaagaggggatgagtattgttgccttagccagagaactggggcagtctcggcagaatttttataagaaactgcaaagggatactttgacacttacggaattaaaggaaatagcgaatgtgcttggagcagatttttcgcgatagctctgtactaccacaaaagtaattatctttcactgacaactgtcctaacacacaggggaagaaaaaagcctaaaagctttctaaaagttggaaaagttgaaaaaatacggtaaaaataggttggaaaaattgaaaaaacatggtaaaaataggttggaaaagttgaaaaaatgcggtaaaaataggttggaaaaattgaaaaataactgtataataaagttgaaaaagatgtaaacttattatacggaggtgcaaaatgttggagcgtttggcaaaaagaaagattcaggaatggcttaaaacaggaaaagatgcatttatgttaactggggcaagacagattggaaagacatatttgattcgtgagtgcttaaaagaaagtggatttccatatgttgaaattaattttatcgaacagccacagcttgtagatgtattctcaaaagcaaaagatgccaaagagttattgatgcgtttaagcttaactgcaaatggaaaattgaaaaaaggaaaaacaattatatttctagatgaagttcaggaatttaaagatatcgttacaagagtaaaatttttggtagaagaaggaagtttccgatatattatgagcggttcattgctgggagtagagttaaatgaccttcgttcagcacctgtgggttatatggaaatatatgatatgtatcctatgggatttaaagagtttgcacttgcagtcgggataaacaaagaaatttttgaaatgctggaagagaaatttaaaaataaggccgttgtagatgaatatgtacattctaaactgttggaagtgttttatttgtatttaattgtaggtggaatgccggaagcagtagatgtgtatcttcgcacgaatgacctggaaaaagtagctcaggttcatgagaaaattatcaggttatataaacaggatttttctaaatatgagattagatataagcttaaattgcgtgaaatatatgatgcaatgcctggacaactggaccagaaaaacaagagatttcaattaaatagtataggaaaaggaatgagttatgaccgggttgaaaatgattttctgtggttgaaagatgctggcgtggtgattcccgtatacaatatagcagaacctaaattaccgctagttattagcgaaaatagaaatcttttcaaattgtttttttcagatgttggtttgttgaccagcagatattccaatcaggtaaaactggcaattctgaatcaggataaatcgattaacaatggcgctctttttgaaaatgtagttgcacaggaattgcttttacatggacataaagaatattatttcaacagtaagaaacagggagaacttgattttgtaattgagctaaatggaaaggtgactccgttggaaataaaatcaggaaaagattataagagacattctgcattaaataacattttgcaaaatcaagattaccagattgatgaagcactgattttttcggaaggaaatgtagaaataaacggaaaacgagtgtatctgccaatttatatgattatatttctggaagaagcgaagctagagaatacggtttataagctagacttaagtggattaaagaatatctaaattgaaatttaaagctgaatatgcaaaaaaaaacaaaacaaaagagctggagggttacgtatccaatgccttaactaaatgacattgaagaaaaaggtactctcgtttcaccgtttaccaaggaggtccaccatgttcattgattcccacatccacctttcccatccatcctactccaccccatttttatattactctccaaccacccattccctttcaaccaccacgcgctcaaacctaatcgaggagtttcgttctgccaaaatctcagcagtcatcgagcctgcgattgagttagaatccaatgaacgacttttagacctcagcagagagtatccagattttgttttcccggcagtaggagtgcatccgacaagaacgccacagacgccttggagtgcgagaaagcaggttgaggagtggtcaaaggataaaaacgtaattgcgattggtgagctggggctggattatcaccatgctagaagagaacagtatcggttaaagcaaaaactgtggtttatctggcagattcttttggcagataaacgtaatcttcctgtcattttacatattcgtcttgcggacagggatgccattcggattttacgattctttaaaaagaaactgcatggcggagtgtgtcattgttttacaggagatgctgaaactgcaaggatttacacacaggaatttggttttctgcttggaattggaggctatcttttacaaggaactgagacgagcagggcattagaagaagcggtgaaagagacacctttggaatttcttgtgctggaaaccgatggaccgtatgtaaaaccaaaagcaccggaggggatttccggaaagcagtggaaaaagagcagaaatacaagtctgatggttccggaagtggcaaagcgtattgccgaaatcaaaggaattgatgtagaggaagtagagcaaatcacgacaaaaaatttcaaaacacacttcaaaatttaacttttttgtcttaaaatggtaaccagatggttgacgttgatagagaaaaataagtgaatgattcgaagggggacattttatgactacatcagaccttgtaaaagaaatgtgtcagaaacagggcatcagtatcgctgcattagcaaaaaacctgggacagacacggcagaatttctataaaaaactgcaaagggacaccttaacacttacggaattaaagcagatagccgaagtgctggatgcaaattttgaacagctttttcgtatgccggacggcacaaagttttctttgaaaagtgagaataaaaaacgaacggtcttaccgcttgttggcagtgcgtttgagccgggaggggcaaaagaggcaattgaaaagttacaggataaggaactttccgagattgcgcaggcggagttgtattatttttcggcacaggcggaaaactgtgtgaagattgtggaaaactatctttccagtgaggatattatgttgagactttcggcagatatgctgtatacctttgcaaatcttacgcttggaaatgcaaaggaagcgcagagttccagagaagacgtctataagtgtttaaaatgggtatttcaggagggtgagacaaacgagaaaaaggcatcctgtgtctttgcgttttatgtcatcagcatttttattcacattccaccggaagaaaatattccgcctttggaaaaatatattccatatctgccaattggtcagcgtctgtttgcgagcagcctgcttgcacatgagacttatcttagaatggagtatgccaaagcgcagggaatcgttcagtctgcgatgttgatgtcggacggaacctatccgatatcgatgatttatttaaattgtgtggctgcgatgtgtcagattaatttaagagagcaggaagaagcgaaaaaatcagtttcttttgcgtgggaaatggcaagaaaagatggatttttagaaccgtttatcgaatatcatggcttgcttcaaggggtattagaggcctgtgtcagaaaaagtgagccggaagtatataaaaaattagtagatggagtgattgcatttagcagaggctggatgaagattcataatccgaagatgcaaaaggcagttacggatttgctcacaccgctggagttctccattgcgatgcttgcctgccgtgactggacaaatcaggaaatcggggagcatctgggattgtcggttaatacggtaaaacattatgtttcgagaattttggaaaaacttcatattgataaacgggataaaataaaagaatttgtaaaccagtaaagagatgtgctctcggaacctttattatacctgcttttacagagtgtctgtttcgtatgatgaaatacgaaacaggcacttttttgatgtcaaacgggcatgtgaaacgaaatccgtttttgataaaattaatgtcaaagatgtaatggttattgagcgaaaaattacctttcaaaagcaaagcaaggaaagaatgcgagagggaataattcaaagaaggggaggggaaatatgaagaaacgtctgattagtatgctgctgagtgcagcattatttgtcacatctataccgatgccggtttctgcggacaatcaagtaaatgaagggaatgcgagtaccgcagtttcaagtgaaggcaatcagggtgaaactcaggaaaatggcattgattataagatgaatggcggtgcttttacatcggggtatgaagcaccggacacttatccggcaggcgaactgccgacagaggaaaatattacaaaggcgggatacgagtttggcggatggtatgaggatgaaaattttagtggggaacgcattacatccttagatacagcagatcattccggagctatcgtactttatgcgaaatggatcgagcgttattattatattgatattccacagacggtatcggcagatggcggtacgctttctatttcagcaaaagcaggtggattttacgacaaagattatgtgagtgtgtcagttgcgtcagaaaatgactggaagctgaaaaacggaaagcatgcattgggttatgaactccgaggggaagagggcggtacaaagctcgaaaacaattcgcttgtaacaagtttaagtgcagaggaaaataagacagaggagaattttaactgtaccgtaacggatacaccgagttatacaggggaatataccgataagctgacgtttgatattgcatttgaagagacacgttataccgttcattatgagacaaacggcggtacgcagtatcaggacaccaaaaatcaagcaggcgaaaatgttgcattaaccgaccagtcctttccggcaggaacggcccttacaaatctgccggagccggtcaaaaaatctgcaacatttatcggttggtgttatgatgcggaatgtaccaagtatgttgacagtaaggacaggctgttaggcgatattacgttatatgcggcttataccgatacccagccgttagatacggtcacgatggaaacttatgcgagagcgtatgatgtggcaacggatttcaccatttcgattaccgatacgagtggaaaattaacggcagaagaacttcgacaggcatgtacgattaagaatgtaagtgacccttcggaagaaattgtattaagtatcatcgaaaacggcgaccagacatttaccgttggaaaggaaaacggatggacggaaggtgcttcttacaaactggaattaaaaaacaatgcgctgtattttaccggctatgacacaagcatccgtgagtatgattttacagtttataaggcagaaattgaaaatgcaaagttaagaagtgaacttaagtacattcatacaaatgatttaagtgatttaaccgtaaatggtcagaaagcaaaatcagtttccgtcgcagttatgacagttggggcagatggttccgtacaggaagagggaagtgaaacttccggaacatttacttataccaaacagaaattaagtgttggagataagattgcagtctattcaggtgatgtgattccgacgatggaactgtcgtccggagaaaacagtgatgtttccttttttgaaattacagcagtaaatggaacgtcttacagctatcgtggcgctgaggcagaagatgtattatttatgccggacgtaattccgcttcttgctgagaaagataaggatggagatctagacaataacagtgcgacagttgctgttagtgatttgacctttggcgatgacgaaatgagtcaggcaatgaatcttaacagtgagacaacaattgactccggtgattttcttgcattttatacggacattaacagcgagacacttttctatggggagattcaaagcgttaccgtttcaggggaggattacatattagactatgtgcctgtttcgtgggaagaaattcagatagcaatggatgtgtatcgaacagagaaagtagatggaaatgaacttttagaagataccgaccgtggcgagtttgaagatgaaatcgaacagcaggcagttgagagtggatttgcaaatgaagtggtagagcggattgccgaagcagcgatgcagacggagtcctttgaagaattagaacaatccttgtccagtgatttgggcgcgggaatttcattgcagccgaatacaaacataaataaaatcatgccgtttgcaggcggaaagcctggtcgtgtgaccgcagagcttgatcacgtaaaggcaaatcttggaacgaccttaaagcattttgatggtgatatcagtggtgtgcgcatggcactcgatatcggtgtgaagattaccatcaaagttgcacagggcgcaaatattgaaattttagtgacagcgacatttgaacaggaagttcgtgtcaacattaatgtaaatggaaaagcagtctggaagagatgggggattttcccgtatattgcagattatcgagtaacggcatcctttgatttatatgaatataccagaatcggtttaaatgtaaactttaaggtcgtagaatccggatttatcgataatggctcgaaacttagaaaaggtgtcaacaagataacagaagaacttaagagcatgatggaaaatggcgaggattatcttgcggataaatcgaaattgtcaggaagtcttggtgattcaggagatgatatttcggtttctaagagccttgccgagcgatattcggaactgttagaagaagattcagactgggtggaaatctataaccgcaagctgctggaacggcatttccgtgtcttattaattatcgatattgaagtacgtttagactttgtagtatctgcaaatgtcaatatttcaatgggtatgagttactggtataaaaatgcaaaacgttatgtgttctgtgtaaaagtaaaagacagaagcgcaaccagtgatacgattgatttatgtgaagaacaatacgaatttaccgcttatgcgatgggaacgcttggacttcgggcaggagtaaggcttacaatcaaagtgggtctgatttctacgaaacttgccagtgtggggatctccgcagaagtcggtggatatgcgcaggtttggggttatctgtattatgaattaaaatatgcggcatcgacgggacggcagaccagggcaatgggtgcgatttatctggaaatcggtatttatcttgaaattaaattccaggcgcaggcacttgccaatgcatttacttacagtccgactttgtatgaaaatgaatggccgctttatcgggttggaagtcttgagagcgtcctggattttgtatatacgcagaatgaagttgaagagattagcatgaagcgtgacattcagtcggtacagctttctgataattacttcaagatgcagtacatgcacatgaaagatggcttaaacgatggaaaatattttgaaaagatttatgatgataattcaaaatactttaacatcgtgatgacaaatccggcatttagttatgaccctgcgacaaacatcatcagcgttgacccgcaaaacaaaccggaacaggatggagaaatgataattacctggaagaaccaggagggcacatttaatacaaaagcgattacaagaaagatttctctgcactgggataaacttcgggatggttattacattgcattccagagtaacggcggttcttatattgaaacaattgtaggaaaatacaatgttccgattcaggcaccgaaaaatccggtacgtttaggttacaatttcgcaggatggtacagcaatgaagaactgaccaaaccgtatacgattccgacaaacatgccggacaatgatgcattggtttatgcaaaatgggaagcagcggatgtggattacacggttgtggactatatggaaaagacaaatggtgtctatgaagcgcagactccggtgaaatataaggcaaagacaggttctaaggtgacaccgactccgacgaaacggacaggatttgagactccgcctgagattaccgagacgatacaggcagatggaagtacggaaatcgagtattattatgcgagagaacagcataaaatcacatttgaatctgagggagaaattctctcacagggaatttataaatacggaagtctcatgccgacaccggcggtatatcgaccgggatatgaatttgatggatgggacagcgaagttccggaaaatgttccggcagaagataagacttatcgggcaaaatggaaaccattagacggtattgcttattctgtaaaatattatatccagaatccggatggagaaggctatgaagtgggtgaaatcaagaccttctccggaaagacagcagaagaagtgactgcaccggaagcagattatgatgaggcagtttaccacttaaaagggcagcttccaaaaggcaaagtaaaagcagatggaagtctggtattaaaagtttactatgatttaaatgaatataaactgacatatgacccggatggcggaacacttgacgagacagaagtaagtgcaaaaccaggcgataagatttcacttccggtaccggttcgggatggatatacctttgaaggctggtatttagacaaagcacatgagcagttatttggcggaacgatgccaagagaggactgcacagtttatgcaaaatgggaaacacagaaagtaaattatacggtaagacatcttcaggaagtggttcataacgaagaagtcgaggcaaacagcgtggaaatcgatccatccattgcggaagaagaaccaatagaagagaataattttgaattagtggaagaagaagtattctctgcaaagacaggtgaaatggtaactccggcagtgaaaagttatacaggatttactgcgccggaaaccgttacagaaaaggttttaggagatggaagtcttgtcattgaatatcgttatcagagaaatatgcatgagattaatctggtatttgatggcaaagaaatcattcgttactggcttcagtatggcgcatcgattgttgagaccccgggaaggatgggatatctgtttggcggatggtacacggatgatacttatcagactgcatttagcggaacgatgccggacaatgatttgagcttatatgcaaaatgggaaccgacagattccgaatacatcgtacgacattacaaacaggatcttcctgcaatcgatgaaaagacttatacgcttgtggaagaagaagtgaaaactgcacttacagacagtgaagtgacaccggaagtaaaaacttatgaaggttttgtttctccatcggcgaagaaagaagtcgtaagtccttatggagataccagcattgaatattattatgatcgagtttccagtccggttacttatgtacagaataatggagaagcagacaaggttgaagatactttatttggtgaagaaatttcctatattccaaaacaatccggttatgcatttgtcggctggtatttagatgaagcattgactaaaccgcttgagaaggcagaaatgccggcacacagtctgaaactttatgcaaaatgggagcttggaaagaaatcctatcgtgtcaaccattacattcaggaagtgcgacttggtgaaaattatgaactggctgagagtgaaaactttatcggcacagcaggtgaaatggtagcaccggaagttaagacttatgagggattcacctcaccggaaaaacagtattatgaacttcaggtatcggatgacatggaagtgttcaattattactatcagcgtaacagttacaatgtgacaatagacagaaacaacggcagtgagaatattacattagaaccggcgtatgaatcaaaaatcgaataccgtccggaaaagatgggttatcagtttgcaggctggtatctcgacaaagagttaaaacaggaatttggtggaacagttccggcgaaagatttgactctgtatgcaaaatgggaggcacaggatgtttcctacagcgtgcgccattatctgcaaaatgcaaatgatgacggatatacctcagcaggtacagagagctttacagcaaagactgacagcagtgtgacaccggaagttaagacttatgcaggatttacctcaccagagacacagacagcaaccgtaacggcagatggaacattaaatattacttaccgttatctgagaaacacccataccttgacagagaaattctgcgatggcagggaagataagattcagacgatgcggtatggttcagcgattgcgggtgtatcaaaagcgggttacacctttgcaggctggtatttggatgagaactatgaaactgcatttaccggaacaatgccggatcaagacctgaccttatatgcaaaatgggaagcaaagaaaatcaattacgtggtggaacactatcaggaaaaggcagatggaaatggttatgttttaaaagaacgtgaaatcaaaactgccgataccgacagcactgtgacaccggaagtaacctcttacacaggatttacctcaccacaggtacagacaaagaaagtagacggcgcagagatgacagtgattcagtatcactatacaagaaatgttcaccgtctgacctttgttcttgaaaatggagaagcagataaggtttctgatgttcgttatcagagtacagtgactgcaccaaatccaaaacgggaaggttatacctttgtcggatgggataaagaagtcgttgagacgatgccggacaatgacgaaacttatacggcagtctggatgaaaaatacttacacaatccgctttaacacagaaggcggaaatgaaatcaaagaaatgactctggaatatggcgaaaagattaccaaaccgaaagatccaacacggaaaggttataactttgttagctggaacattgaaattccatcggaaatgccggcaaaaaatctgatgtgcaccgcagtatggaagaaagaaacttataccatcagctataacttaaatggcggaagtgcttctaatccggcaagttacgatgtggaaagcagaccaattcgtctggaaactccgaaacggacaggctatacatttaccggatggagcggaactggactttccaagaaagaaatgaccgtgacgattccaaaaggttcaaccggaaaccgcagttacaccgcaaactggcaggaaaatacttacaccatctgctttaccacctgtggagtcggcacaactggttcaatggaccagataaaaatgaactatactcagacaaaacaattgccggataacaaatttgtttgtaagggctacaccttcatcggatggtcttataaagcaaatcagaccattgcatattatagagaccacgcatgggtaagcaaactttcggatgcaaataatggtgttgcaaccttgtatccggtatggaaagcgaacacgtataaagtaacctttgattacggatatgataacaagaagtcagaagttaactgtgtatacaacaaaaattattcgcttccacagaatgtaacaagatacggctggtcctttgaaggttggaaactgaaaaatgcgacagcagtaacctataaaccaggcaagaaaaatgcaaaacttgaagatgcagaaaatattgtgttgcatgcaagctggaaagcaaataattcgtacagttatcgtccatcaagttcgtcaaacagatatctggttacggatgaccatgaactgactaaatttacattctatgtggatggaaatcagacttctgtaaagacaaccggcgatacgggacaaaatccggcaagatatcatctgaatatgacgaatctttcttatcaggcagttcataatagctacagcaagatgaagataaagataagctttaagattacgatggaaaaagatggatatgcagatttaagagtttcttatcattccagaacacaaaataagacttatgaaaaatggaaaaccgaagtagaagacatcaaggcgaagaacggagagaccgtaacgtatacttatacaaaagacggcaccgatgcagataatatcacattggaatttgacgcacatggaaaaaattctgataaatattatctcagcaacttaaatgtagacgttacttatgagtagtgagcaagggggaagtgcagatgaacggcaaaaataaaacaaataaaatactaatcggaattattatctgcctgattgcagtgattattggaggggcaatttattttacaagaggtacagacaaagacaaggaaaataaaactctggattcggctttcgagccgaatctggactccaacgcaagcgagactgcctcaaatgacgggaacaatgaagaagctgataaaccggaaggaatccggattccgggatatccatcaattacagttccggcagatacaacagacatagaaatgaatctggaaaatccggccggaaatccatgctactttacatttgaactggtgttaaaagatacaaatgaaactctgtatacctcgaaaatggtagaaccggggaaagcaattacgaacgtaacactgtcgcatggacttgaaaaaggggaatatccggctgtgataaagatttcgacagcatcacttgaggatggctctgcaatgaacggagcaaatgtagaaactaccttgattgtacagtagtaataatatgcgctcggagtcttcaatgcacttacttttatggctgattttttgccagctgtacccgaattttatcaaaaaattaggcacaaaaagattccgaacgcacataagaaaggaaagacaggaggaacactatgagaagaaaatggttttttgccggaatcttttttacagtgatgcttgccaatactgtctatgcaaataatacgacaacggtaagttatacagtaaatccggcatatacagtgctgattccggtggatacagaagttgaatttaatcagttatcagaatcatttggaaagattcaagtagaaaaagcacagcttgatgagggaaaatgcattgaggtttctttaagttctgacggagtattgaaaaacaaaaataatcggagtgatgtgattccttatcagattttaaagacgagtgaagcgacaccatttgtgtcagcgaggtatcacacggcaggagaagcgacaccgcttaccatcagtattaaacaagatgactggaacaaagcaccgtcgggagattactcagataccgtgacatttacgatttcctacgtggatgataaataaatgagaggggaagtattatgaagaaaaaaacaattatggcagttttaataggaatgacagtcataatgacacaacagaggattatcgttttagcagcaaccacttcaggtgatcggcaaagcagtaccgttagtgcaactgtaccggataaacatacgattacaatcgataaagatgcgcatgttacgattacttatgaggactcaaaagatgaaggggagggagatgcatttccgatagaacgcttttcaactccaacctttacgattgaaaccgaagacggatgggagattgataaaatccttttaaatggcgtagatatcaccagtcagctgagcaataaaaagctgacgctgccatccgtttatcaaaatgagacgctgaaaatttcaacgaaaatcaaaccggcatataccgtagtgattccacaggataccaatgttcagttcaataaattgacagaaaactttggaaaaatttcaatggaaaaagtatggttggaagatggaaaatgtattgaagtatcgatgagttccgcaggaaatctgacgaaccagaaagattcaagtaaattaattccatatcagattttggaagaaggaaaagatactccgtttacatcagcaaaatatacggcgcagggagaagaaacttctctgcttatcgacattaaacaagatgactggaataaagcggcatccggttcttactctgatactgttacgtttacaatctcttatgcagacagtgaatgatggacgtgtctgatttgtcatctactgcgttagcgtcaatcaccgtagctccgctacgtttcattccgctgccttgtatatgaaaaaatcattcaacgtcaaatatcaatgtagtagagatttgctatacattatacttgtgaattggaggaggataatgtgaagaaaaaaatcgctgtgctggctggaatctgtatgcttgtcagtgtgcagggaacggtttttgcagccgataggaattcgcccgatgatttgtcagaccagacggttcaaagcgtaattcgtgcagacgtgcccgattcccataagattactgtaaaaggagagcatgttacggtcagtcttgagggaggaaaccaagaagaaaaccaagaagaaaacagtattcttgtagaacggttttcagaaccaaagttgaaattcagccctgaaaaaggatggaaaataaaaaaggttctgctcggagatacggatgtcacaagtcaggtaaaagatggaataatcactttggcatctgtgtatgaagatttgatattaaccgtcgagactgaaaaaatcaaagacgaatccggcgcaaaaacagattccaaatcaaacacaagcttcggtcagaaaacaaatcaaaacaataaaaataatcagacaagcacaacaaatggaacaaaaacaactgcaaattcaggcagtgcaacaactgtgggacagggaatcaaagcagccgtgacagaagatgaaatgaatgtgggaatttatggaatcggagcggttgcagcaggaggaatagcagtgcggtgcttgaaaagaaaaaagaaaaaaatctgatttttggtatattgcaaaatggaaatggaatatgccataatgccaataggcaaagagatacaagtcatccataggtgacaaaaaacgaaagagccagaggtggggtagacctctggctctttctattccaatttttgcagcaatttatctcttttctcaactaacaaattaaactattgcttgtgatacacaaatataaatggtactataaaagagaaaagactcctaaaaaaattaagaaaggggcaagtttatgggaagagaaggagaagttaaagtaaagagtctgcaaaaagcaatggaagtattagagtgctttatacaaaagcagccgcttggagtaacagaaatcagtgaaaaactggggctgtataagagtaatgtgcataatattctgatgacttttaccgcacttggatacttaacacaggatgatgaaaccggaaagtttcatctgggagtatccgtaatgactctgagccgggcatttcgtgaaggacttgatattacaagagtcgcagtaccatttatgcgagaaattgcaaatgaggcaggagagctgatctatctgacaattccaaaagatgacagtgtaatctatctggaaggaatttcaccggatcatcaaagaatggtcagtaaatcggttgcaggagaagactgtaagatgtattgcactgctgtaggaaaagcgatgcttgcaagtatgccgaaagaagaagtcgaaaaatgtatttcagggaagcttgaagcgtatacagaaaatacgattacagataaaaaaagtctcttagaagaaattgaaaaaacacgaattcgaggttatggaatcgatgatatggaaatcatgtttggcattaaatgtgtgggagttgcactgttaaatcatgatggaaaagtggaaggtggactgagtatcagcgccccatcgcttagaatgagtgacgagaaaattgaattatatgcaaatatacttaaggaatatgccgcaaagatacaaaaaatgttataaacttgtgcaagtttactgaaaaataaaaaagcagaagaaaaatattgaaaaaaaacacaaaagatggtaaagtagaattatcaaataaagaacgtagttctctaataaagaacagatgaaagaggaacccgacaggaagtcgggtaaaaaaatgaacgaaaataagaacactgttctgtaatagagaacaaaggaaagatttagggaggataaaaaatggcaaacaaaccgtatgtagtagtggaatggaatgacacagagacagatgcaaaaggatggatgtgtgcgtacaacttcgttggacattattgtggcggtggaacaagaatgcatccgacagtaacaaaagaagaagtaattcgtctggcaacaacaatgggatacaaatataaagcatgtgaatcccagacaacaggtggatgtaaagcaggtattgcttatgattacaaagctccagatgcactcgatgtattaaagagattcttaaccgcaactgctccttatattaacgcaggtgtttccatcggtggagacttaggtgttgattattcagacgtacttcgtatcttagatgaactgggaatcggaattcctcagacaaaagcaatgaaagaagacccagatatccatcagggaattgtaaaccatgacagagcagaaaaagaattaacctatgacggatttaaaatgtatgacatgattaccggatatggtgttgcagctgcagccgatgaagcctggaaattaaaaggcggaaaagaaggcgcaagcgtagtaattcagggattcggatgcgttggtgcaagttgtgttaactccttatataacatgggttataaagtagttggtatcgcagatgtaaacggactggtttactgcaaagacggattgaatattccaaaattagttgaaacaagacttccaaaaggtgaattaaaccgtgaagcgtttgaagataattatgaagttcttccaaataccgaatggatttcagcagactgtgatatcttaattccggcagcacttgaagatgttatcaataaagataatgcagataaaatcaaagcttctcttcttgttgaagcagcaaatattcctaccactccggaagcagatgaaatccttcagaagaaaggcgtagatgtagcagttgactttatttccaaccttggtggaattcgtatttatgaagctgttattttccgtattgtaaaaattgaaaatatgaatgatgaagaagcagcaaaagcaattgtagatgatacagtaaatctgattcgtaaacagactaaacttgtatttgaagaagcagcaaaaaccggagaatttacaagagacgttgcaagaagattatttacaccggataaatctgacacaccggatatgtaagaaaaaacttacagaaatacaacgtgaaagaagttgggggctgtcggaaagacagccccctttttcagtttatgggatgagaaacattctaaattaggaaaaaagaggagggtgtttatggagtcaaaagcgagaaaatatttgaccattattgcattagggcttgcaggaggttcaatttatttcattccttatgtaaaatatgtattttacgatgcacagcttgcggcaatgggaattaataatacacagtcaggtttattgctgaccatgtatacgattggaaatatggttctttatattccgggcggatatctggcggataaggtatcaacgaaaaaagctttgattatatcgctggtagcgacatccgttttaacgtgggtttatgcattttcattaaattttgtcgtttctatgattatatggcttggtctttcctttagtacagcctttgtattctggtcagcacttatgaaagcggtacgaattgtaggaacagaagaagaacagggattcatgtatggtttatattacgcttgtaatggaatcgcagcagctttaacaagttttatttctctgtatgcttataatacagcaggcgaagacattaagagcggatttgtacgtggtgtaaatgccagcggagttgttgttcttatcgcagccatctgtttagtattcttaatgaaagaagatgcaggaaaagttacaacagaaagtgacgatgataaaatttctcttccaatggttggaaaagttttaaaatcccctgttgtgtggattttatcaatcgtaatcttatgtggatatggattaaaatccagtgtttcttatttcaatccatatttaacagaagtagttggtgtttcagcggttaattcaggtattttctcaattattaataattatctgttgttattacttgcaccggttggtggaattttagcagataaggtatttaaatcaacatgtaaatggttgagtgtgtcatttgtgattcttgcagtattattcggtggagttttattgattccatctgacatcagcccgatggtagcaagtatttatactttacttccaggggcagttacaatgatgatgtatggggttgtattttcatcagtcagtgaagcaggtatttcaaggacaatgacgggaacggttattggaatttcatccattattggttatattccagattccatttattccgtaatatttggtaagtggttggataataaaggtgcagcagggtatacaaatatctttattttcctggttgcatccggaatcgtaggagcagttctcgcattttggatttatcgtcatggtaaacgtgcacagcatgatgcgtgatgcattagtaaaaatatatgaaggagaagcaagttatgggtaaagagaaaacagaaaaggtgtatacaaacccggtaagatgcaaaggctgcggatattgtattaatgcctgtccgcaggaagcaatcagtgtttccgatcatgtaaatgcaaaaggttataacacgattgtagtagatgaagaaaagtgcgtggtatgtggtatgtgttatcgtgtatgcccggattatgtatttgagattagataaggaggtcagtcacttatggcgaaggtattattaaaaggaaatgaagcgctggccgaagccgcattagcagcgggctgtcgtttttatagtggatatccgattactcctcagacagagattctggagtatttatcatggagaatggaagatgtaggtggagtatttattcaggcagaatctgagttagccggaattaacatggtgcttggagcagcggctgcaggtgcaagagcacttacaacttcatccggtcctggattttctttaaaacaggaaggaatttcttatttggtagcagcagatttgccggcagttattgttgatgttatgcgaatcggaagtggtcttggagatattgcacagggtcagggagactactggcagcttacaagaggtggtggtcacggagattaccatacactcgtacttgctccggcttccgtacaggaaaatgcaaacatgatggcagaggcatttgaccttgcagaaaaatatcgtcatccggtgttgattgcatctgatgcagcgattggacagatgattgaagcagttgaaattccggaatttgttgagcatgatatcaataaatttgactggaccatcaaaggatgtaaaaaaggctgtgaacagcgtaaaattcagaacgtttattatacacatcctgattatgaaggctatttatcctctaaatatgcacagatggaagaggaagaacagcgctatgaaaatattcaggtagaagatgcggaagtggttctggttgcttatggaatcagttcccgtgtaagcagggaagcagttgaaatcgcaagagcacagggcttcaaacttggtttgattcgtccgattactttatggccattcccgaaaaaagcatttgaagaagcaaaagaagcaaaagcattcttaactgttgaaatgaatattttaggacagatggtagatgacgtaaaacttgcaacagaaggcaaatatccggtagatcattatggttctatctttgaaattcctgaaacagatggaattattgcaaaagcaaaagaaatgttaaaaaagggggagatataatatgagattagtagctcctgaaacgattacatttacccagagtggtttttgtccgggatgtggacatggtttagcagtacgtttgattgctgaagttatggaagaaatgggcttaagcgaacagcttttagcagttgtagacgttgcctgtggttcattaaatattgactcctggagattcgatacaattatggcagcgcatggaagaccaatcgcaacagcaattggtgtaaaaaaagttcgtccggaaaatccggttatggcatacatcggtgacggtgcagcttactcaatcggtatggcggaaaccatgcatgcagcacttagaaatgataatgtagtgacaattgttattaacaacagtttatatggaatgacaggtggacagtgtgcaccgacttctcttccgggacagattacaacttctacaccaagaggaaaagatccgaaaaaagcaggtatgccattccgcgtagaagaagcatttaccggttttgatattgcatatctggcaagaggttctatggcagatgcaaaaggcatgatgcagtcgaaaaaatatgtgaaaaaagcatttgagaaacacatgaagggagaaggattctgccttgtagaattattatctccatgtccaaccaatctgaatatgactcctgttaagagtgtggaacgtattaaaaacgaaatgatgcagtacttcccactgggagaatttaaagataagaaagaggaggaatagacattatggcaaaagaaattatttgtgccggatttggcggacagggcgtactgacagccggaatgcttttgatcaacgccggtatggaacaggataaaaatgtattgttctatccttcttatggttctgaaatgagaggtggaactgcaaactgtacagtaaaaatcagtgataaattaattgcaagtccaatttccaaacaaccggatattttatttacgatgaatacaccggcaattgacaaatttgaagaaagattaaaaccgggcggactgcttctggtcaactcatccatcgttccggatgacagaaaatatcgtgatgatattaccgtagtaaaagttccggctactgacattgcagtagaagtaaaaaatccaaaaggtgcaaacctggttatgctcggtgcacttgctgcccacagtgacttattctctattgaatatatggaaagcgcaattgtttctttctttgagaaaaaaggaaaaggtaaatttaacgagaaaaatgttgcctgctaccgtcgaggtgtagaaggaaaataaaaactggaggtaacgggaaatgaatttaaataaactgttgaaaccaacatccgtagccgttatcggtgcaagtgaaaaagaaggatttggtggagatgtttgtagaaatattttaagttacgtggaagatagaagccatgtgtattttatccatccaaaaagagacagtgtttttggagttccatgttataaatccatcagcgatgtacctgaaaatgtggatttaatggtaatctgtacttcacagaaaacagtaattccgcttttacaggaaggcgcaaaaaaaggcgttggcggagcagttgtatttgccagtggttatggtgaagttggaacagcagaaggaaaacaaaatgaagcagaactgattgcagcagcaaaagaactcaatattgcggttatggggccaaactgcgcaggttttgtgaattatattgataatgtacaggcattcgcatttatctctgcaaaaagagacagaaaaggaagcgttggtgtcgtgtcccagagtggtcagctttgtctttccatgatggatgacccgggaatgcgtttctcttataatatttcagcaggaaatggaaaaatcgttcaaatggaagattatatggacttccttgtggacgatgaagatacaaaagtagtcagcatctatattgaaggtgttaaaaatgcagataaatttgcagctgtattgaaaaaagcagctgaaaagagaaaaccggttgttatcttaaaagcaggacgaagtgcaaaaggtggagcaatcgctgcttctcatacaggaagtctttccggctccgatgcatcctttgatgcagtattgaaaaaattcggagcaatccgtgtagatgacctggaagaattaattgcaatgtcactcatgctttctactatgaagagaatgccggaaaaagcaacatttgcttctatgaacttatccggtggagagacaggaatttgtgccgatgtaggaagcttaaatggaatcgaatatccggatttcaccgaagaaactctgaagaaattaaaagaacagcttccatcttatgcttctccaaacaacccgctcgatatgactgcaagtctttcttatgatgcagacctctatgcaggagcacttcggacggttatggatgacccgaatatcggtatggtactgattggatatactctgcttcttgaaattgcagacccgtgtatccattacatgtataaaggaattgaaaaggtagttcaggaaaaaggcggtaactgcaaaccgattgccatgataccatttgcggagaacacaagaaatcctgaatatcaggaaaaattattccagataggcgtaccggttttaccgcctccggtatacgccttcaaattactccgccatctggctgactttatcgcttatgaaccggagacaaagactctggaacttgcggtaggacatccgaagagcgaagaaacacaggcattatctgagcatgaaagtaaacaggaattaaaagtatacggtgtaccggtaccagatgaagtcatcgtaacatcgaaagaagaagcagctcagtttgcaaaaaatcatccgggtccattagtaatgaaagtagaatcagctgatatcctccataagagtgatgtgggcggtgtaaaattaaatgtttgtggtccggaaacagcagaaaaagcttatgaagaaatcatggaaagtgtaaccgcaaagagaccggatgcacacatcaatggaattctgacagttccaatgttagatgccggtgtggaaatcatcataggcgtaaacaatgacccgcagtttggaccgatgatcatggttggaatgggcggcgtctttgtagaagtctttaaagatgtagccttatatccggcacctctgaaagaagaggaagcgcttgaaatgttgaaatcactgaaatcatttaaacttcttaatggatatcgtggaactgagaaatgtgacataaaagcattgtgtcagacaatcgtagcaatcagcaattatgcccaggccaataaagatgttttaaaagagctggatatcaatccattgtttgtatatccggaaggtaagggtgtcggtgtagcagatgctctgatcgtaaagagaaaataatgtattagctagtccatttggtaaaaaataaattcagagatatcccgtagaagtcaaagatgacagactacgggatatttctgtttttaagagaatgtgctctgagagtacataaggaaatttagggggatatatgattcgagaaataaaaaaagaggaaattgcggagctcattcagaaagtagatgaattaggtaggtatttgacaaatcatccggaagtaagtggagaagaaaaagagtcatgtgaatacattacgcagttcctgaaaaaagagggatatgaaatcactgcgccttacggagaaatgccatattcttttcgggcagtggataaagaaaaaaaacagtttcatggaaaaaaagcggtttttttatgtgaatatgatgcgttgccggaagtggggcatgcttgtgggcattcttacagctgcgcaatcagtattttaggagcattattgttaaaaaaattttatccggatcttccgatgcgaattgatttagttggcacgccgggagaagagtttgttggtggaaaatgttatatgactgaaaatggagcatttgatgaatatgaatatgcagcaatgattcatttatataacagagattctacatattttgaaattcttgcatcaaatgatagatactttacgtttcatggaaaagcagcgcatgcatctgcgttcccggaagagggggttaatgctttgaatgcggcgcgtttatatatggaagcaatggacatgtggagacagcatattacaaaggattgtcagtttcatggcattgtagtaaaaggcggagaagctccgaatattgtaccggaggaagtttgcctggattattattatcgagctgcaacgctggaaaatttatggaagttaaataagatctcagaaaactgtgcgagaggtgcggcactggcaaccggtacagaagtggagtggcagcagagatatccggattatggagaaatttattggaatgaatatatggatcagattatgaaagatatttttgaacatgtaggaagaacttgtgaagattctccgggacctggaggctcttcggatattggaaatgtaaatttgaaaattcctgtgtttcatcctttactggatattacgggaaaagataaaacgtgtgttgtgcatgatcgtcgttttgaacgaattcttcatacaacagaaatgcaaaaagcactgtatgatggtgggaaaatcctgtatgaattgggatatttgctggctacaaatgaagaaaagttaaaaatcataaaagaaatgcacaaaaaatatagaaaattagtctgaaaaaggttaaaatatataaatgtatgcagcgggggacattggaataggcttgaatacgaaagggggcagtttatgcgaaaactatttgaaaacatagaaaagaaaatatttataccggcgtttttggtattaattgtactgacacttacgatttatctgtttccaggtcaggtaaacggagtgatttcgattttattttcactttgtacccatgagcttggctggttgtttatgctgacctgtctggcatcatttggatttatgatttggctgacattcagcaagtatggaaagatcaaacttggaaacaaagatgaaaaaccacagtacaataatttgtcatggattgcgatgttgtttacagcgggggttggaacaagtattgtaattcttggatttttagagccgatttattatgtgagtgcaccaccatttgatttggaaccgtttagtaatgctgcatatgagtatgcacacatgtatgggcagtttcattggggcttcagtgcatgggcattttataatccggcgattgtggcaattgcctatgtgatgtatgtgcggaaagaaaacagtatccgcttgagcaacgcctgtcgaagcgtgcttcataaaaaatcagatggatggcttggacacattgtggatattcttgttgtattcggtattgtaggttcgatttctacatctcttggaatcggtgcaccggtgctttctgatattatccgtgaagtgtttggtatccctgcacagtatgattttactgtaaaaattattgtgttgattatctgggtattaatctttggaacaagtgtgtatctggggttggataaagggatccagcggttaagcaatattaatgttgtgctggcatttatttttatgggactgattcttttgattggaccgacaatgcagatttttaagatggaagtaaactcaatcggtttatatgcatctgattttatcaagatgagcacttatacagatccatttggagaaggaaaattctccagtgagtggacggtattttactggggatggtggattgcttttatgccgatgatgggaatgtttgtcggtaagatttcaaggggaagaactatcaaaaatgtaatgtggggacagcttctatgggggacactcggatgctgctgcagttttatgatttttggtggatattctctttacctacagcagtccggaaaagttgatttggcgaccatccttgcagaagaaggaaatagcggtgcaattattgcaattttgcagacccttccaatgtctaagattatgatgctgttcttgtgtattgtctgttttgtctatctggcaacaacgattgattcgtgtgcttatgtactggcgggaacaacgacaaaacgcttatcctataaagaagaccctgcaagatggaatcgtatcttatgggcagttttattttgtgtcttatccattgggcttatgattattggtggattggaagctgtaaaaacgatttcggtgttgacgggactgccactgattgcagtgttgattgtgctgatggtttcagtgaaacgaatgttgaaagaagacgaagaaaaggaagaaaaaaggaaatagaaaaattttaactaattaacattcaagaatagccgcttagtttaggagacgtgggcggctatttttgtgatttatgattatctttacctatttacttataacagtcagtttcaatttttctaaaaataatcactgttgaaactctcaggatatgattcaataaacttaacaataaaaataaagctgagaaaggggtttataaatgataaaggttataaaaaatcatggaaaaacagtgcatgcatatcgcctgggagaagacagtgaaaaaattcagcaattaataaaagagaaaaaaatcattccgcttccgaatgataaattcgaagtgaaatcctcagaaacgctttcaagtcaaagtgagcatggtgaaattgcaaaggcaggagatttcattaaagtggacagtgatggtaatccctatccaaatggtgcagaatggttttatcgaaatcacagacatttggcaggagatgaatatgaacagcttccgcagactttagacgcctggacgtgcaatgagaaaatgtgcagggagattgagtttttaattcaacataaaggacttgtaataaacgaacaagaggaggcagattattttgtagcgccactttggggaacaacagagactgccgcaaaggatgctgtaattgtattttacggaattacatatacagagaacggtgaaattatggatgtggagtttaattttgtcaaacgcacagaatttgataaaacctaccatatcacggaataaaaaatctaaaaaaataatgcgtttttactgcgagttttagctatatggctagtgtacaaaatttgataaactgatataataaaattacgaatatatacgtaaaaaaataaatttgtgcgaaatcagcagaaaggaaggtattattatgggtcttattaaagcgggagttggagcgataaatggagtattggcggatcaatggaaagagtttttctattgcgaagcgctggataagaatattctggtaactaagggacagaaacgcattggcaaacgttcctctaatacaaagggcagtgataatattatatcgaatggaagcggaattgcagttgcagacggtcagtgtatgattattgtcgagcagggaaaaattgttgaagtctgcgcagaacctggagaatttacttacgatcgttcgactgaaccaagtatttttacaggaaaactgggtgatgggattaaagagacgtttaagacaatcggcaaacgatttacatttggcggagataccggaaaagaccagagggtttattattttaatactaaagaaatcatagataacaaatttggaacaccgaatccattcatgtttgatgtggtaaataaagacatcaatatgagaagaactgttcaggtgcgctgtaatggtgtgtattcttataagataattgacccattgttattctatacacaggtttgtggaaatgtagagcgtgagtataccagagaagagattgaccatcagttaaagacggaatttatcgatgccctgcagccggcatttgcggcactttccgaattggaacttcgtccggcacagattccggcacatacaaaagaattaaaagatgccatgaatcgtgcattaaagatagaatggacagaacgaagaggaattgaagtacaggcgattgccttaaatccaattacactcactgaagaggatatgaagaaaatcaaccagatggaggatgcagcaacactgggcagtaatccatttatgatggcaggacgtatgacagatgcaactgcaaatgcaatggaaaatgcagcttctaatccaaatggggcaatgaatggatttgtcgggatgggcatgtcgatgaatgcaggtggagcaggtgcaggctttggcgcagcgcagagcttttataatcagggagttcagcaacaacaggcacagcagcagatgcagcaaatgcagcagaccgagcagcagacagcacagaatcaatccgggcagcagtctcaggatagttggaaatgtgcatgcggagcagttgtaaccggaaaattctgtaccgaatgtggagcaaagaaaccggaaccaattcaggcaggaagatggaaatgcaaatgtggagcgatggcaaccggaaagttctgcccggaatgtggctcacctaaaccattagaggatggatggacctgcacctgtggaacagtaaatcagggaaaattctgccagaactgtggagcaaagaaaccatcgggtgcaccgttatatcgctgtgataaatgcggatggcagccggaagacccgaagaatccacctaaattttgtccggaatgtggagacccttttgatgagaatgatgttcagtaaaaaatatattttaggctcttttgatatttaatttgtgaaaatatttttgatgattgtgtcagaatttctaaagtataagtaaatgaaagttattacatcataagaaaagagagggggaaactgcatgggaaatttacaggaatataagtgtccgtgttgtggaggcgcaattgagtttaacagcaaacttcaaaaaatgaaatgtccatactgcgatactgaatttgaaatagaaaccttacagggctatgaaaaagaacttcaaaatgaacagtctgacgatatgacatgggaaacttctgccggaagtgaatggcaggagggtgaagcagaagggcttagagtctacacctgcaaatcctgtggcggagaaattgttgccgatgcaaatactgctgcaacatcctgcccatactgtaataatccgattgtgatgaccggacagtttgagggaagcttaaggccggattatgtgattccgtttaaattagataaaaaagcagcaaaagaaggtttgatgaaacatttaagcggaaaacggcttctgcctaagattttcaaggaccagaatcacattgatgaaattaagggagtgtacgttccattttggttgtttgatacagatgcagaggcacatatccgatatcgtgcaacgaaagtgagaagctggagtgatagcgagtacgattataccgaaacaaaacattatatgattcacaggggcggaaccgttgggtttgaacgaattccggtagatggttcctctaagatgccggatgatttgatggaatcgatagaaccgtttgattttaaagaggcggtaaaattccagatgccgtatctggccggatatttggcagataaatatgatgtaagtgaggaagaaagtgttgggagagcaaataagagagtgaaaaaatcgacagaaaaagcatttgcgtctactgtcaaaggttattcttctgtgacaacggaaaacagcagtatacagttgcaaaatggaaaagcaaagtatgcgctgtatccggtttggattttaaatacgacctggaagggagaaaaatatctttttgcgatgaatggacagactggaaaatttgttggaaaccttccggtggataaagcggcagcaggaagatggaccgcattgcttacagtgatatttggagctttgagttatggcattatctggctgttttggttgtttggtgtgttatagagggagggcggaaaaatgaagaaacgaatttttacagtttttttaaccatacttctttttatgctttccacagtgggagtctgggcgtcagagggatcagatgacagcggattttcaggggagtatgaacgtctgactgatgcagcaggattattaagcgaggaagaagcacagaatattttgacaaagctggatgaagtaagtgagcgtcagaagtttgatattgtaattctgacagtagatagtcttgaaggcgcaacagcgacggagtacgcagatgatttctttgattattatggctatggatatggcgaagggaaagatggaattttattcttagtcagtatggaagacagagactgggcactttcaacacatggatacggaattactgcatttacagatgcaggatgcgattacatagcagaacagtttaagagttcactttcagatggtgaatatgagaaagcatttgaaatttatatcgaccagtgcgatgcatttgttacacaggcgagagaagaccgcccttacgacaattccaatcttccaaaaaaaccacttggaatgatatggattccagttgcactggtgcttggatttatctgtgcattttcaattgtaggaggaatgaaacgacaattgaaaaccgtggcaagaaaaacaacggccggaaattatcagaaaaaaggcagtctaaaagtgacagaaagcagggatttattcttatatgaagatgtaactcgtacagcaaaaccaaaatccagtgatggggattccggaagcagtacccacacttcatcgtcgggggaaacacacggcggaagcagtggaaaattctagcaaattgggctgaaagttagtctttcaaaggggagtatataagggtataatgaaagaaaaattaagactgattttgttagagaagggaaattatgacatgaagattgcaattttaggtgctggaagaatcgcagtacatatggcagaaacactggctggaatggatgatgttgaggcttatgcagttggagcaagagaacttgagcgggcagaggcttttgcagagaaatatggatttacaaaggcttatggttcttatgaagaaatgctggcggataaagaaattgatttagtctatattgctacgccacattcccatcattataaacacgcaaaaatgtgtctggaagcaggaaaaaatgtgctgtgtgaaaaatcatttaccgtaaatgcaaaccaggcaagagcactttttaaactggcggaggaaaaaaatctgttaatcacagaggcaatctggaccagatacatgccgtcaagaaaaataattcaggatattgtggaaagtggagtgattggagaggtaacttctcttactgcaaatttaagctatgcagttacagaaaaagaaagaatccgtaaaccggaacttgcaggaggtgcactgcttgatgtcggagtctatccgattaactttgcaagcatggtgcttggtgaaaacctcaaagatgtgcagtcgagtgcaatttttgaaggcggcgtcgatattctcgaaaccattattatgaattttgaaggaaataaaatggcaacgcttcagagtggtgtcagagaaatttctgatagaatgggaagtatttttggaacaaaaggctacattcaggttcaaaatatcaataatccggagaagattacagtatttaaccagaaccatgaagaaacagcaagctattttcctccaaagcagattacaggatacgaatatgaagtccgagcttgtaaaaaagcattggaagagggcaaaattgagtgtccggaaatgcctcatgctgaaacggtaagaatcatggagattatggatggtttgagaaaaagctggggatacgaaattccggaagtgtactagacttaaataagtatgttataaagtgataaaacaaatgtccatacagacagcaaagcaaaatccccgatgttgccgcatcggggatttttacgctctagtagaaaatgtcaagaaagatttaaaaattttgattctgtcagtcgccttttaagactacacgaattctcttatagattaaaaatacaatcaaagaagtcagtgtgtatttaaataagttaaatgggaaaataatcaaggctgcaaatgtcagaagattatgaacagaaccatgaacggcacttcccatctgaataaatgcatcaaccggcattccgaatgcttttccgtaagccggaagcagaataaatgcattgataaagcaggctacaacagaggttaaaagtgttccggcaatcattccgagaacagcatgttttctatttttcatagaacgataaatgaaaccggccggaacaacgaaagcacatccaaagataaagttggcaacatcaccgacaccggctgtcattgtaccctttgttaccagatgaactaagattttcacaagttccacccagacacctgcaagcggtcccattgcaaaagaaccaactaataccggaacttcagaaaaatccagctgataaaaacttggtgctaaaaaaggaatcggaaattccagattcatcaaaattcctgcgattgcaccaagcatcgcaatctgtgtaattgttcttgtacgacttcttgtcgatacatttcttcttaatacctgttcactcatttttcgtttctcctttaaaacttatgattttattaagagaattctttgaaaatttcttagtctatagcatatataacaagtttccataaactaaaaagcccttggaattttttccaagggcttgagcacgtatttaaaaatttgcgcgttcttctctcatccagactatactgtcggtttcggaatttcaccgaatcagccgcttgcgcgggtcgcggactataccgccggtagggaatctcaccctgccccgaagaattctctttttctttgtcctcattatactatatatgtattctggtttcaatagtgaatctgtttttcacagttcgcttgaatttacctttgtttccgagtataatgaaaataattataggatgttttctatttctataagtgagaattgaggaggaacttattatgattaagtggaacaatttaaacactctttcttcatttgagaatctttcaaaagtagaacgtgtaaaactcgcagaggtaatgtcaggagaaaacggtgcagaccgtgtgaaaaaatacacaattcctatggcagccggtctttcttacaattatgcagcaaaacaggtagatgatgatgtattagaagcattaaccaagttagcggaagaagcacagcttgcagaaaaatttgaagccctctacaatggagaagtcatcaacacaggagaaaaacgtctggttcttcatcacatgacacgtggtcagttaggtgaagcagtagaagcagatggtgtggataaacgtactttctatacagaacagcagaagaaaattgcagattttgcaaataaagtacatgccggtgaaatcacaaatgcagcaggcgagaaatttacaacagtagttcagattggtatcggtggaagtgaccttggtcctcgtgcaatgtatctggcactggaaaactgggctaagaaaaacaatacatttaagatggaagcaaaattcatcagtaatgtagacccggatgatgcagcagcagttttgaattctattgatgttgcacattctatttttgtattggtttccaaatccggaacaactctggaaacactgacaaatgaatcttttgtaaaagatgctctgaaaaatgcaggcttagacgcatccaaacacatgattgcagttacaagtgaaacttctccgcttgctaagagtgatgattatcttgcagcatttttcatggatgactacattggcggtcgtttctcctctacatcagcagtaggtggtgcagttttatctctggcatttggcccggaagtatttgcacagttcttacagggtgcagcagaagaagataaacttgcaatgaataaaaacgtcttagaaaacccggaaatgcttgatgcattaatcggtgtctacgaacgtaacgtattaggatatccgagtacagccgttctgccatactctcaggcactgagccgtttccctgcacatcttcagcagttagatatggaatccaacggtaaatctgtaaaccgttttggtgaagcagtagattatccaaccggtccggttatttttggtgaaccaggaacaaacggacagcactctttctaccagttactgcaccagggaacagacattgtaccgcttcagtttgttggatttaaaaacagccagattggtacagatgttgtaattcaggacagcacaagtcagcagaaactctgcgcaaacgtagcagcacagattgtagcttttgcatgcggaaaagcagatgaaaataaaaacaaaaactttaaaggtggacgtccatccagcattattatcggagaagaactgacaccggaagcacttggtgcactcctcgctcactttgaaaataagattatgttccagggattcgtatggaatgtaaacagctttgaccaggaaggcgtacagcttggtaaagttcttgcaaaacgtgtccttgcacatgaaacagatggcgcattgaaggtattcagtgatttattaaacatctaattctttaattttaaatttttaagagaaagtctgtctgtatagaaaaatcttgcggacaggctttttttaggatgaatgtaaacttataaaaacaaaacggttgacatttaattcttttatggatatactaaattttatacgcaaaaacatcgaaaaatgagaggaaagtatattatgtcagaattatccatcacattacgtttagaaaactgggacgagagcagaccgctgactcgtgaggaagctgttgaaattttaaatcttccggaagaggaaatgccaaaacttctggattgtgcttacgcacttcgtacgaaatataaagggaaaaaagtcagtgtacagctattaacaaatgtgcgtagtggaaactgttcccagaactgtgcgtattgtgcacagtctcgtgattccgaagctccgattgaaaagtatcgcagagtttccgatgaaaaattatacggagataatgatttggtggatgaaaaacatctggcaagacattgtattggcttaagtggaatcggtttctccgatgaagaaattgaagacttggcagatcgtatccgtgaaatgaagaaaaaggaaacacagatttgctgttccatcggatttttaacagagaaacaggcaaaaatgttaaaagaagccgggctggaccgcatcaatcataatttaaacagcagtcgttctttctatccggaaatctgcaccactcatacttatgaacagcgtgtaaacaatattaaaatgcttcagggcttaggttttgaaatctgtagtggcggaattattggaatgggcgaaagcaaagaagatgtagtagatatgttgatggatttaagagaaatcaatccggaatccgtaccgattaattttttacttccaattccgggaacaagactggcagacagagatatttcagaattaacaccggagtattgcctgaaggtgctttgtcttgcaagactgatgatttcaaaatcagatattcgatgtgcagcgggacgtgaagtttatttcaaaggaattgagccgactttatttaaagtagtggattctatctttgcttctggatatctgaccgcaggcggacagggaatcgatgcgacaatgaaaatgatagaagaagccggatttaccggagaaattgaatcgacagatgaagagtaatagagaatcataaagcccaataaagaaataagggaaaagacaaagaagctgaaaaaatcgtttctttgtctttttttgtgctataatcaaaaaaataaaaaataaaaaaacttacaggaaggacgaaaatcattatgaaagaaaaacaaaccggcagttgtgaaagctgtacctattatatttacgatgatgaatatgaaagttatctttgtgatgtcagcatggacgaagatgagtatatgagactggtttccgatacgcattatcagtgtccgtattaccgaaatggaaatgaatatgcagtagtaagaaaacagatgtaaagaacagtagtaacaatatagaagcagaaaaaagcgaatagtaatcacgttagaaaaagaggagagagcgatgacaaaagatttgacgacaggaaaaattatgccgatactggtaaaatttacggtgccgcttgtccttgggaatttatttcagctgacctacaatgcagttgacagtattatcgtgggacattttgtcggaaaagaagcacttgcggcagtcggaatctgcaatcctgtcagtacactgatgattttatttttaaatggactgtgtatgggtgcaagtattttgatggggattcaatatggggcaagggattataaaactttgcaccgccagattagtacaacgatgctttcaggtgttgtattttctgtatttttaacacttatttgtgtcatttttgcggtgccgattttgcggttacttcaggtagacccatcgattctggaaatgacaaaagaatatttgagaattattttctggggactggtatttacttttttatacaactttttttcaagcacccttcgagcactgggagacagcagttctccgttgtattttctgattatcagtgcagttttaaatgtatttggcgatttgttttttgtcgtggtattaaaggctggatgcaatggctgtgcggtttcgacggtattaagtgaagcattgtgctgtttattctgtgtaatttatattcagaaaaaagtgccgattttgcgattgggaaagaaatggctggtgtttgatgcaagtcttttaaagcgaacgattgcttatggatgggcatcggcaatgcagcaggcgacggtacagcttggaaagattgggattcaggcgattgtcaatacgatgggagtttccgttgcggcggcatttgcggtggtaaacagaattgatgattttgcatatacaccggaacaaaatatcgcacatgcgatgacggcactgatggcgcagaacaaaggggcaggaaagaaagaccgtatgcgggaaggattccgttgtggatttatattggaagtgatttatggaattctggttttaattatctgttatgtgtttgcaagaccgcttatgatgctgtttgtaaaagatgaagaggtaatcggtcacggtgtgatttatttacagttgatttcacttatgtatatacttccgggaattacgaatgcacttcagggatttttccgtggaattggagatttgaaagttaccttaatcagcagttttacaaatatgggagtgcgtgtacttgcagccgctccgatggtttttttatggggatttggaattgaagcacttccgtattcttatctggcaggatggattggaatgttacttgtggaagcaccgctgttaattaagatttacaggaagaaataaggcacaagctgaatagaataataaaaaagaaaaataagaaagcagaaatctatgaaattagagcttttgcacatttcaaaacaatatggcaaaaaaacagcagtggaggatatgtctcttgttttgacaaacggcgtgtggagaatttccggaaatcctaaatgtggaaaaacaactctgcttcgtctgattacaggaagcgtgaagccgacagagggaaaactcttttataacgaaagaaatatttttgaagattattcacaatacaaagcagtgcttggttatctgccgcagcattttaaaccggaccatttatttacggtaaaggaatatctgaattatatttcagcttataagggcttatcgaagaaacagacaaaaagaagaactgcagaggcacttggagcacttcgtttgtgggaagtgcgggacaaaaaaatagcgagactttcaagaggaatgagacagagagtcggaatggcacaggcagttttaaataagccgaaggttttagttttagacgaaccttcggcttatttagatgaaagagaagaaaatctgttttatgagctggcaggagaattttttcaaaactgcattgtgattattacagagagaagcagtttggatgagacgagaagcagatgcgaggaagtagcggactggaatctgacgatgaaaaacgggaaagtggggagtatttagaatgaactcaataagtgcgaaattaaaatcggaaataaaacgaacattgtatacaaaatggatttggtttgcaggatttttggcatgtctacttggaaagataacccagatggcaggacaggacagcattacatggaggtgtatttttattgcttcggcaattttaatcagtgaagttttttggctgtttgagctgaaaagcccgaaagatgaggcagtactctgcacgaaatacggaaaccggtggatgcatcaaaaaagagcagtgattctgtgggtgctcgtgttattgattttattaatttccggtttataattttgtcagaataaaacaaagagacattcgatttttttcggatgtctcttttgcatatcaaccgttttacttaatcaatcacttttttgattgcatcaagcagttcgtcataagtttcataagccggaatttccggatattctgctttgattgcttctgtacttttaaataaaaatcctgctttacttgcctgaatcataccaaggtcattatggctgtcaccgcttgcgattgtgtcataaccaatggactgtaatgcttttacagtagtatatttggatttttcacagcgcatcttaaagtctgtgatttctccattttctgcgacaacgagagagttacagaagatggtcggatagccgagttttttcattaaaggtccggcaaactgggagaaggtatcactgataatgataacctgagtcatttctcttaacttgtccaaaaattcctttgcaccgggaatcgggtcaatctttgcgatggtttcctgaatctcttttaatccaaggttgtgttcttttaaaatgtttaagcggtatttcatcagcttatcataatccggctcgtctctggtagtttttttgagttccggaataccggtttcctctgcaaatgcaatccagatttccggtacgagtacgccctctaagtctaagcaaacgatttccattttttcctccattctaaagcaggttgatagggtccattctatcgaaccctgcttttgcttaagtatttatctattcttatcaaaacctattatattagaaaacgaaaaaaaacgccactgaaaattttacgttttaatgcgataaaattttcaatgacgcttagaaatcattttagaatcaaatacaggattcaattaatcttaaaataaatgattgaattgtacttaaatagtggtaggtgattttttatttctcaattggaaaccagccaaagtcaatgcatcttccaaggtcccagctgtcccagccaacccatccaggggtgtttacagtatcggttagcagtttgtagctccagtagaagtatccgcttccggcatcccatgcatctaacatggcttttgcaagtgtgttgtaaatttcttttttcgtttcagcactgatacattcttcgcttaaaccttctacaccatttaatactgtctgtccgcctttggtgtcatgtccaacagcgagagaattgaataagcaccattccccacagataaccgggaagtattcctgcatttctgcaatgtcttttttgagttcttctacataagaaacatagttttctacgttctgttcacagccgttcatctcagcaaccatcaggtactggtgcgtatcaagtacaacgtttttatatttttcttcacgcatgaaatctttccatgcttttaagcggaaggcatcatggaaaacaacgtatttttcttccggcatgtgtttgcggattctgtcgtaagcctccaaataaaaaccgcggataaattccattgtatttggttttgttccctttgctttttcagggtcaactgccggatagcgttctgctacgttcatagattcccacatatcttcaagtataggctcgtttaaaatttcgattccccataagccttttcttgtaccgtatctttttgcaagtctttcaagaacagtgagttcaaattcaacttcgtccggatcctgtgaccatttgcagacaccactgattccgccattatcaaatccgttctggctgtccggtgcagtatgtaagtcgattaaaatctgaagtccatatttttcagcccagttaaatgctttgtcaagttcttcgatacatccgataaagggctctctgtcgccaaagatgaaatacggaacagggattctgactgcatccattcccatcgatttgattcttgtgaaatctctttctgtgatatattcagaacgatggattttgatttttgcctcataaacttctttggaaagttgtgttggaagataatattcatcttcagcagttgttccatcgaataaagatgggctcatccatttttcaagtaccagccagttaccaagattaacaccttttactttcatgtgttctgtttcctttctcttttttaaaaaattttttatttaaaaatgtgattcattgttttttgcaatcgttattttacccatccaaatcttaaatttatatcataattattggaaatttatcacttatattgtgaaaaaatctgtgctataatggaaaagcaaaagaaaatgcaaaaagaaatgcaggaagaagggagcgtgaaaatttgaatatagattatcttgcatggcatgtttcacatgaacttcatacatttgtaagacgctggagcggtgaattaaaaccggataataagccggaaattttttgtgccagaaaggatttaaaagacgattatttttctttttcagagtttgaagattatatgaatcaatgtctggctggaaaatttgtgtctgcgtgtccggtagttttttcggcaggtttaaaagagaatcaagtcgcttatgcctatcttcaggcaggagatttttactatttagtcggaccggtacggtttgattcaaaggttcgtctgtattatcatattggagaatttgaaatcccaaagagcgattttaatgcggtatttagttctgagttttattttttctgttctaatattttactgatgtgtaatctgtttcgcaaggaaattttgacaagggatgatattgtctatgaaaactgtgaagaacagattcgagattcggaaattatggaagaatactcggcacttatctttgaaaggcaggaacttgaagaaccacacaatccttatgaacaggaaattcgagaacttaccagtattgaactgggtgacatcgagatgttgaaaaaaagtattggagaagattatcttggaaagaccggcgtgctttctaaagatgaactgcgcaatacaaaaaatcttggaattgtggttatgacgcttgcgagcagggcggcaattcgaggcggattaatgccggaaatctcgtattccatgagtgatgtctttatccagaaaatcgaagaaatgacagatattgtggcgatttatacggcaatccgtcagtttgaaatggaatatgcaaagctggtggcagaaatccgtaagcaggatgagaaaaaatccaaagaaaagcagagtatctgggtggaagccagcaaagagtatatctttaaacatctgcatgaaaagattcgggtgcaggaaattgcagattacctgcacttaaattccagctatttatctgaactgtttaaacaacaggaatctatgacactgactgattttattttacaggagaaagtaaaactgacgaagaatctgctgacgtattcgccgtattcttacatagagattgcaacttatctgggattttcttcgcagagtcatctgggaaaagtctttaagaaatatacggatatgacccttaggcagtatcgggaacggtatggaagagaacagatacaggaacgaagaaaggcagaattaatatcaaatgaatgaggttgaggagttaaccgaatcaaaaagaaaacagcgaagcggaggaaaaatatccgcttgatacaaaaaagaaagaggaaattaaaaaatgggaaatgacttatttgaaaaagcaccgattccgaaagcttatttcagttttgcgcttccggtggtatttagcatggtgatttcgctggtttataatatggcggacacctattttattgccgctaccggaaatacgaatctggttgcgggtgtttcacttggcgcaccgatttttacgttaatgattgcgcttggtgatatttttggactgggcggaagttcggtgatttcacgactattcggcaaaaaaatggatgaggacggaaagcgtttaagtgtgttctgtttttatggagcaattgtatgcggaattgttgtagcagtgttgatgatgttgttccgtgcaccgattttaactctattaggtgcaaaagcggataccgtgcagtatgcatcggattattatacttggctggtaatcggtgctccgtttattattttatcttttacgccgtctaatctgcttcgaacggaaggattttcagtagcatctatgacaggaacggtgcttggctctgtgattaacattatcttagacccgatttttatcttcgtgcttggcatgggagcagccggtgcagcgatagccacggtaatcggaaacatcggtgcggatttattttttgtatttttcttactgacaaaaagcaaacgtttgtccatcaatccaaaaggattttttatcagcaaaagagaacttggagatatctttgccatcggaataccggcatctgttaccaactttatgcagagtcttggaattgcgctgaccaatcgttttttactggtctatggaacagacaaagtggcttcgatgggaatcgtaatgaaaatcaatatgattgcaatgctgattttagttggctttgcttttggttcacagccgttaatcggatataattatggtgctggaaataaaaagcgtctgaaagcgattctggcatttagttataaatttgaatgtgcaatgggagctgtgctagcacttattttatgtgtttttgcaaagcctttgatttcgatgtttatgaatcaggaaagcatcgtaaatgcaggagttccgatgctcagacttcagcttgcaggtgcagtatttactgcggttacgctcgtaagtacctgtacgttccagtccgccggaaaagcattaaatgcttttcttttatctgtcagcagacagggcgttatctttgcagttgtgatttttattttgtctaaaacagtgggctattatggagtactttcggcacagccggtgtcagattttcttacagctgtgcttgccgtgattctggtgagaaggagcgtataccgagagatacgataaaaaattagaaaataccgttattgtggtttacaaattgtcaaataaaaggtaatatacttttataaaatattttataaaaggaagcttttgtatggcgggaatagagaaaaaaaatgttacaaaatctaaaattgtgaactacattatcaatcataaggcaacgtctaaggtagagttatctaaagatttaaatatcagtatgccgacagtattgtctaatgtaaaagaattgctagcaggtggaattgtgattgaaacaggagaatacgaatcaacaggtgggcgaaaagcgaaaaagattagtattaatcctgcatatcgttatgcggttggaatcagaatcactgcaaagcatatagggtttgtgcttgtaaacatgaagtatgaaattgaaaaatatgaaagaatacgactggaattttcaacaaatacttcttattattcaaaaatcagggaagaattggaggcatttcttaaggatgtagaaaacagggagaggattctgggaatcggtatttcgattcctggaattgttaacttggagaatcgaatgttggtgaaatctcatgctcttcaattagaaaattatagcttgaattttctggaacaggtgttttcactgccggtatactttgagaatgatgcaaatgcagcgatgagagcagaagatttaaatagatataaaaatgcgttgtatttatctttaaataatactttgggtggtgcgttttgtattgatggaaaattaatcttgggagaaaatcagaaggcgggtgagtttgggcatatcattcttgttccaggcggaaagcaatgttattgtggaaagcgtggatgtgcagatgtttactgtgcggcgagcgcactgacggatgataccagccaaacattagaacagtttatgcagcagttagaagaacgaaaggaaagtgcacagcaggtttggcaggaatatttggaatatttagcggttttaatttcaaatttgcggatggcttatgacatggacatcattcttggaggcgaagtgggtggatatctttcagattatatgattccattggaagaaaaagtgatgaaatataatgggtttgaccatgatgcaagatatttgaagatatgttcttataaaagagaagcttctgcagtaggtgtggcaaagtattttttgcaggagtttataaaagatatttagttgcttgtaaaagagaaaaagttccagagagaaagcagtttaaagaatgttttctctctggaactttttttgctttctggaaaaatgcataaattcacagaaacaatcttgtgcaataggcagaattaaacgttgggatattgacaaattttatcttttggataataatgtaattactttaataaaatgtttaataaaagaatataaataaaggaggaaatacattatgttacagcaggtaatgacaaatccaggagaaattattttcagagaggtaccagttccagaggtgaaagacaatcaggtgttggttaaaattatgaatattggaatttgtggttctgatattcatgtataccatggaaaacatccatttacaaaatatccggttacacagggacatgaagtgtctggtgaaattgcaaagattggaaaagatgttacagagtttcgtgaaggacaaaaagtaacaattgagcctcaggtatattgtggagaatgttatccatgtcgtcatggaaaatataatctttgtgaagaactcaaagttatgggatttcagacaacaggaacagcttctgaatattttgcagtagatgcgtcgaaagtaacaccgattccagaggagatgtcttatgaagaaggtgcaatgattgaacctcttgctgtagcagtgcacgctgtaaaacagatgggcgatgtgaaaggaatgaatattgcagtgcttggagcaggtccaattggtaatctggttgctcagtcagcaaaaggaatgggagcagcaaaggttatgattacagatgtcagtgaccttcggttagagaaagcaaaagaatgtggaattgatgtatgtgtcaatacaaaagaaaaagattttggtgaggcaatgattgacgcctttggtccggataaagcagatgtaatttatgactgcgcaggaaataatatcacaatgggtcaggcaatcaaatatgcaagaaaaggaagtgtaattgttcttgtggctgtatttgcaggcatggcaacaattgaccttgcagttgccaacgaccatgaactggatattaagagtacaatgatgtaccgccatgatgattatgtagatgggattgcactcgtaaatgaaggaaaggtacatttaagaccattaatttctaagacttttgcttttaaagattatttgaaagcatatcagtatattgatgataatcgtgaaacaacaatgaaagtaattattaatgtgcaggaaaaatagaacgataaattttggaaggatggggtttagtcagaaacgctgataaggaggaagttatgggaagtgagagtaagaatggaaaagtgccgttgattagtaaaatcgcctatggatttggagatgtaggctgtaattttagctggatgtttgtcagtaactttctaatgattttttataccgatgtgtttggaatcagtatggcagcggtatcagccttgatgcttttttcaagattctgggatgcaatcaatgacccgattgtaggaggactgacagataaaacaaatacaagatgggggaggtatcgcccatggcttctgattgcggctccaattacggcggtgcttttgatgctctccttctgggcacatccagactggtcgaatacagcaaaaatcgtttatatggtaattacatattgccttctggtattaggctatacttgtgtaaatattccgtacggaacactttgtggagctatgacacaggatattgatgaacgtgcaaaaattaatacttcccgttccgtgtcagcgatgattgcaatcggaattattaatattgtgacagtgcctttgattagtaagctaggaagcagtagtgccaaaaaaggctatctgcttgttgcgattatttatggatgtatctttgcagcctgtcatttcttctgctttgcaaagacaaaagaacaggtaacaatccctgaaaaagagaaaatttcaattaaagtacagctgaaagcagttatgcagaataaaccatatctgcttgcactggttggacaggtattgtttggatttacattgtatggaagaaatgctgatattttgtattattttacttatgttgagggaaatgcttcttactataccacctattcaatgtgcattattattccttctattattggtgcagcatgcttccagccagtattccgtaagttaaataataaaggaagaacagcttctatttttgcattacttacaggtatcgcaatgcttgctatgtatttctttaatgtaaaagaatcaccaatcacattttatgcattagccggtattacacaatttttcttttcaggatttaatactgcaatttatgccattattccagactgcgtggaatatggtgagtggaaaacaggacttagaaatgatggattccagtatgcctttgtttctcttggaaataaagttgggatggcagtaggtactgcgtttcttgcagcattacttggaaaatatggatatgtggcaaatcagacacagaatccggaagtaattgcaattatgaaacatgcattttcaacgatacctggaattttgtggattgttacagcaattgttctgtttttctatcgtctgaataaaaaacgctataatgaaattgtggaggacttgaaaaatggcaaaagaggttgatattgtcgctttaggagaacttttgattgattttacagaggcaggaaaaagtgattcaggaaaaaagctgtttgagcaaaatcctggtggcgcaccggcaaatcttttaactctagcctcacgtatggggtatcgcacggaatttatcggtaaagtcggaacggatatgcatgggaattttctgaaaaaaactttggaggaagaaggaatcggaacaaaatatctgatttaggatgaaagatattttacaactcttgcttttgtagagattgcggaaagtggggagcgtcagttttctttttccagaaaacaaagtgcagacacacagctttgtgcagatgagttaaatcagaaattgcttgaagattgtaaggtatttcattttggttcgttgtcattgacagatgaaccggcaagaacagcaacaatagaagctgtaaaaatagcaaaatcatcaggtgcacttatttcttatgaccctaattatcgggcatcattatgggaaaagaaagaaactgctgtagaacagatgaaatccatgataccttatgttgatgtgatgaaagtgtcagatgaagaactagttttgctgacaggaaataaagattatagtcaggcagttaaaatacttcttgatataggaccaaagttagtggctgtgacgtttggaagcgaaggggttcttcttgcaacaaaacagagacaggagaaactaccaggatttaaagtgaaagcgattgatatgacgggggctggagattctttctggggaggcttttaaagtgagtatctaaaacaaaataaaaaaattgaagagcttacatgggaagaacttaaaaagtgtgcaaagtatggcaatgcaacggcggcattgtgtgtgcagagaagaggtggaattccggcaattcctaaaaaagaagaagtagaaagtttgtgtaagtaaatgatgcaaaggggaatgtgaaaaaaatggattttcacgttccctttgatgttttatcgagagatacgataaaaaattatatttaaaaatccaaaaaaatcagttattttatttccaagtaaagataaaatgtacttttgaaatgtactttcaaaacattccaaaagtaaaaaagtacattgaaatatacaggaggaaataaagttatgattcataatccaattttaccaggattccacgcagacccatgtatctgtcgtaaaggggatgacttttacgttgccgtttcttcttttgagtggtttccagggattccgatttatcattcaaaagatatgaaaaactgggaattatattctcatgcgctgacaaatgccgatgactctgatttgaaaaaactgccaagtgcaaagggaatctgggctccgcatctgaccaaacatggtgattattattacattatgtgtgccgaaggtgatacaggatattatcacagtgtgacaatgggtcgttctaaaaacgtatacggaccttatgaggcagacccatgcaatccgattttaacttctgcaccaggaaattataacgaacgtgcagattgggatcatttaaaaccacgttactacaatccagagagcaaacttcagaaatccggtcatgcaagttatgtggatttgccaaatggagaaacctggatggtgcatctgacttccagaccatttgtaccggaacttcgttgtacacttggtcgtgaaactgcaatccagcgcatgaaatagaaataaaaagttccagtttagtttttttaagaactattctggaacttttttgtgcatatcaggaagggttcgtacgaagttgtatattggagataacctccgatgcacactaaaattattaataattggaaaaatacaccgtaatcgtacagatttcgctgtctgttccaacccgcattgccggaccccagacaccgactccggaagttacaatgctgttcagattacctttttttaagtaaccgcagggattttcccagaataattttaccgttagatttccgggaaaaatctgtccatcgtgagtgtgaccgcataactgcatatctacgccggcattatcaagttcttcaagttgttttggctgatgttccaggacaaaaacaggtttggttttatctacgttcgagagcagttcttcgatagtttttcggttcgttgtgccgtctcctggtttttgaatatcttttcggccaacgagataaaaggcattgtcaatacaggtgacttcatcatcgagaagagtgatatcggcatcttttagaaaactttcaaatctcgggtcacggacttcgttttcttttgatgtaactgaaaatccacctaagagccgttctgtcacatcatggtttccgaacacagcataagagccataagtactttgaatcgtagaaagtgttttggcaattttatctggattttgaacggcttcatattcgttgtcaaaaacgtcgcccgcaaatacaacaaggtctgcattttgtgcattgattttctttaccatgcgctgcatctgcctgtcatcgacactgtaaccaagatgcaaatctgcagcgagaacgatttttaaagaatcatgtccggcgcaggatttttctacagtaatatcataaggcgtcacttttacgtgtttggaatgtaaaattccataagcgctgataccgcagataagtgcggtaagcagaagtccaacaaatacatagccggctttacaaaagaaaaactcatgtatttttccagtaatttgttttaaaatcagccggagaatatctgcgactgcaataaacattaataaatataaaaatgtgccaagccagtagttgctgattcgctttacaagtacctgaaattcagaggcaggcagtaaaaatgcaaaaagcagagaaagcgccagcaaagaataaatagtaagataaggcacaacaaaccatttggaatgaaaacgctcagaacatgcagtcagccatttatggattcggtgcaggatgtaggcgtttaataaaatataaatgggaatgatgaatattaaaatcataatagggcttcctttttgtttttcagaatagcacaaatggcaggaagaagcaaatgaagggtgggcatttgatttttgataagaaaagacatataataagtatagctaagaaatgcgattatactctaagtgagtaaaaagaagttcggagtgccagctctgaacttctttttttctgattttttatgctaatccctcaattgcttcttctatgatatcagcaagtttttctgttgtaatttccataaacagtgactgcatcggtccaaatgaatcaataatttccattagttttttgcggtcatgaggattttcttttaattctttatactgaccagcaccatagatgatgcggactggcccttcataaataaaatctttcatgagctacctccaaaataaaatgttatattagtgtgtccgtatagtagaaatattaatatactagggtaacccgagggcaagaaaaattttatcatatctaaagtttacaatgtagaataaaaaggctaaaggtggaagttagttttttatttgaattttcacagaatgttcacaaaaaattagcactcacctcttgacagtgctaataatacgtgctatagtacaattagaacaaaggaagagggaaatagagagagacaaagaaataaaaaagcctttcccctctggtttgacctaagttccaaaaaagaaacaggtaaacagcaattaagattttgagataaaaaaggagagatgacttatgttgatgcctagtatttttggagaaaatttatttgatgacttttgggaattcccattttttgataacagtaaagaacagaaaaacattgaaaagaaactgtatggacatcatagtaaaaatatgatgaaaacagatatcaaagaaactgaaaaaggttacaccattgaaatggatctgccaggatttaagaaagatgaagtcaaagtagcacttgaaaatggttatctgaccatagcagcagcaaaaggacttgataaaaacgagaaagaaaaagaaaccggtcgttacatcagacgtgaacgttattcaggtgcttgtgaacgtagcttttatgtaggagcagatgtaaaacaggaagacatcaaagctcactttgaacatggtatgttaactctgtttgtacctaaaaaagaagcaaaaccggcagtagaaacagataaatatatttccattgaaggataagtagattcctctttaaacaaaattaaaataaattaaaaaaccgccctgtgcacttcgttggagttgagatgcacagggcggttttgatgtaaagcggatattcgtaatccaatttgttacctgattaattcagtcaaataaattttctcttgtaatattctgtgcccatttaccctgacggtaatgatgcagtacccaaggccatttcacaaattcatctgtacataataagaaataaacccagagaaccggaagtttcaggacaaaggcagcgaagaatccaagtggaactgcgtagacccacatatcaatggtatcacagattaatccaaatttggtatcaccaccggctcggaatactccggcaatgagtgcggtatttacagccgaacccataatataataagtgttaattaagagcatatattttaagtagtgcattgcctgatcatttagagaggcaaatctcattacaaaaggtgtgattgtcagtacgatgacaccaccgattgctccggcaatcacagtcatttttaacattctggatgcataaactttagatttttccaagtcaccttttcccataacattgccaagcagaatggttcctgcactggcaatcgcaaaacagaacacggaaccaatgttacggactactgtaaccagagaattagcagctacagcatcggtacctaaatgtccaagaataacagaatacatggaaaaggctacactccatgagacatcgtttccaagtgccggaagtgataatttaataaagtcgtttaataaaactttactatggataaacatataagccggatttagttttacgtttttactcagaaaagaaacaatgatgcaggcaattagttcgattagtcgagaaaaagcagttgcaatggcaacaccggctgctccgagttttggaagtccaaataaaccaaaaataaagaccgcatttaaaataacatttaaaacaaaagcaagcatatttaatgccatactgatggttacccgtccgatacttcgcagaattgcaagataaacttcggtcacgccccagcataaataagtaattcccatgattcttaaataagaagagccgatggatattaactctgggtcagaggtaaagattagcatcatgcggtttggcatcgtaaatgcaatcagggcaacgacaccggaaattgcgattgaaaaacgaagggcaattccttcgattgcgtgaatcgcctgtaaattattttgtccaaagtattgtgcacataaaagcgatgcacctgtgccaagtccataatataccataaacaggatattagaataactggcagctaaagaaactgcggaaattgcggattgtccgacataattgagcatgattacgtcggcggaattgacggctgcacttaacagattttggatgataatcggaagtgtcagccgaaacatttgccggtaaaagtcatctttaccggttgaaactatatttttcataaaaatcccccataaattattataaaatttattataatgtatttgagagaaaatttcgtcctttattctgacggatttctacgttattttgactgtgatgtttcttctgtctgcagggttcacagaattttcacaaaaaattagcactcatctcttgacagtgctaataatacgtgctatagtacaactagaacaaaggaagagggaaatagagagagacaaagaaataaaaaagtctttcccctctggtttgacccaagttccaaaaaaagaaacaggtaaacagcaattaagattttgagataaaaaaggagagatgacttatgttgatgcctagtatttttggagaaaatttatttgatgacttttgggaattcccattttttgataacagtaaagaacagaaaaacattgaaaagaaactgtatggacatcatagcaaaaatatgatgaaaacagatatcaaagaaactgaaaaaggttataccattgaaatggatctgccaggatttaagaaagatgaagtcaaagtagcacttgaaaatggttatctgaccatagcagcagcaaaaggacttgataaagacgagaaagaaaaagaaaccggtcgttacatcagacgtgaacgttattcaggcgcctgtgaacgtagtttttatgtgggagaagatgtgaaacaggaagacatcaaagctcactttgaacatggtatgctgaccctgttcgtaccaaagaaagaagcaaaaccggcagtggaaacagataaatacatttccattgaaggataaaaacattccttttagataaagacagataagtaaaacgccctgtgtattttttaaaaaaagagatgcacagggcgtttttttgcacttactcaaaataagttgacatttaaatttaaaatatttataattctaattgtttgaattataaatattttggctaaaagaggaggggaatttatggatgattcattacactatctgattatggcaaatcagatgcttgttcagcgtggtctgttagagcggttaaaggaaaccggacttacaattggtcagccaaaggtgctggattatttaaaggagcatgatggaagtaatcagaaagaaattgccagggcgtgttttttggaggcgggttctttgacttcaattttaaaccgcatggaagaaaaaggactggttgagaggcgcatgttaaatggaaatcggcgcagttttcatgtatttctgacagaaaacggaaaaaaaaatcaggaactggtggaagaaatgtttgcggagattgagaaagatgcactggatggaatttcatcagaagaatttgaaactttcatggaagtatatcggaagatttatggaaatcttttacaggcagaacgaaagacagagaaagaaggaaaaatgaaaaatgaataaattaaaacgatatcttttatttttagtaggattatttgtaaatgcactgggagtcagtcttgtcacaaaagcaaatctgggaacttccccgatttcatcgattccttatgtattaagtttgaatttcccatttactttgggtaactttacaattttttttagtatttttttgattgtgttgcagattttaattttaagaaaaaactttaaactggaaaatattttgcagataccggtatccattgcatttggatattttattgacttgacgatgtatctgtttttctgggtagacccacagaattatctgttgaaaattgtggcactgttgattggatgtggagtgttaggatttggtgtttatttagaagtggtcgcagatgtggtgatgcttccaggagaatcctttgtccgtgcaattgtgcagacctggaacacaaattttggaacaacaaagattatctttgatacttccatggcggtgattgcagcagcgttatcttttgtgtttgccggaaaattaaacggagtcagagaaggtacaattattgcggcacttttagttggatttattgcaagactgcttggaaagaaacttgagtttattaagttattcttattcccggaggaatatagaaaccaagaagaaattgaagaagcagatgagacagaagcagagcagaagtcaaagaacgtaattgtgatcggcagatagtatggaagtggtggacacgaaaatgaattacatagaagagtgtataaaaaaagcaatgtaaattaaagcagaaaagcagtaattttatccggaagtcttggtataatcaacttatgaaattttgtatgaaaaataaagatgtactttcggaatcatatcaaagctttcaagagtacatgaaaaagattgggaggaatcagtatgccaaaacgcttctgtaataaaagaaaaaaacagcttcggaattaagtttccggagctgttttttctataaaatcaagatatttaagacattcatccttatgtggagcatttttgataattccaacatagatatccccatcaaattttgcattttttaaaagtggaaaatccgagacattgatactgtcagagagatatccttttttatttaattgttccattgcttctcgattcataaatacgaggtctattttttttgcgtcaattgcagcaagaagtctggtgcttgatgcataagcgtattctaagttttccgagtctggattctcctgtatcagtaaattgtcataagtacagatttcatttttctttgcagataaatgttcaaagtctaaaaaatcactggtcagatgctgagagagagattcgctcatattaacattaataaatgcaatcgagagaacagttgttttttttacaagctgtccgtggatattataaacaagaatataaagtacgatgcaaataataataaaaggcagtttgtaataatcccaaagatattgaagttttgcttttccgtgaagttgttttaatgctttcatagaacatcatccttattattttcaagtcgttccagaatcggaagaatcagccaggagcagataagtgctccgagtccttgtccaaaaacaataaatggtgtgaaaatattgattataacatagtaaataacaaaataaacaactgccatcaaaatagaacagaacagataacgcagtcccatgacaagtgcatttttaaaagttgcaggaattgtattttcaaatcgtgcaaataatggaaaaacattcagtaaaacgataaggtatacaactccggcacagatgagcactgcaccgcataaagtccagaatacattttccagacgaatatgataaagcacatagccgtcaattccaaataggatgccaagccccaaaagagggagccagatcagtgtggcttttttgaaattagaacgaaatgcagtaaagaactgctttgtaatattgccttcttcattgcgtacgagtttgaatgaaacataataaagggcagttgtcgaggcaccgattgtaaaaacaggaatacaacataaaaaccaaagggtattgagccatgcagcacaaaaaattttgtttaaaagctggatgaaacgattatcaattgaaaaaatctgattcataatattctcctttacttggttggagcaatgtttacggattctcggtatacaatgtttgtttcggtataaacggttcgataatttaaagtcggatcttttattctggagagcaataaatctattgcacaaactccaagaatttcattgtgaatgtggatactggtaagcggtggagtgataagtttagcagcaggagaatcgtcaaagccacatagacaaatatcctccggaacttgaatatttaattgtcttaatatttgcatcagatcaaaagcaataaaatcatttgcacagacaaaaacatcaggaagttcttttaaattttgaatatagttaaaaagataagttttataatctgtgagtgtgtcttttggagcgtctataataaaaaactcttcattaattggaagcgaatttatatagagtgcattacgagtagccatgcagcgttcaaaaaaagattggcaatgcaactgctcgccgataaatccgatatttgttttgccacattttttcatttcacgaacgaaggcaaaaatttcatcctggttattcataagtaaacgatcagcaggaagaggttttcccataagtaccggatggtctacaaataaaaccggaatatccagattgcaaatcatttttgcgtagtcatagttaaaagtttcaatacagataatgccacagacattctcaggatgaaacgaattgggaagctggtagttggcttgttcttcattgcttacgcggtgcatcgtaatgatatagccaagttgagtggtttctctttgaatcttatctaacattgtagaagaaaaatgaaaattatcgagcggagcgcaggttaggattgcaatttcaccatgaggcttttgtggagttgcttcttgtgaggaaaacttaagttgttctgggttcatataggtaaattgtttatagcccatttctaccgttttttgtaacactttttctctggttgaatcagataagactcctgtgttgttgatggcttttgagacggtatttcttgatagtccaagagcatcagcgatatcttgtatcgtcacacgttttgacataataaaatctccttttcagttctaaaacaataattggactgttacaaatgtaaaataattatatgagtttattatagaataaatttgcgaatgtgtcaaatgtaaaataaatagtaaaaataaacaaaaaaacaaggaaaaatgagggaaaaacagcatatagcatcgtgaaattcttacaaaagtgtgcgtatgtaacaataaatagttgacatttgagtataaaattgatattatgatgacataagcaaaacatgttatgtttacaaatgcacacattctgtagaaggaggaaagaaaatggaacagaaaaagaaatctggattcggtaatacggttgcatatgtgaaacgtcattggcagttgtatgtattctttttattaccggcattgttgctcactttgatttttaagtatattcctatgggcggcgttttaattgcatttatggattataacccggttcgagggattcttggaagtgattgggttggactggaacatttcagaagatttttatcatcaccggactttatgagatatttagtaaacacattgaagcttagtgtgtatggcttattgtggggctttccggtgccgattttacttgcatttttgttaaatcgaattgttagtaaaagaaagaagaaaaatattcagctcgtgctgtatcttccgaactttatttctgtcattgtattatgtggtattgtacgaatcttcttgtctgtaacaggaccggtaaacggattgtttggaacaagtatcaactttatgacaatgccgtctgcttttcgtacgatttacattgccagtggaatttggcagggggcaggctgggcttcgattctgtatacagcagcactatcaaatgcaagtcaggagttaaaagaagcggcagtaattgatggagcaaatattttccaacagattaaagcggtggaatggccagccatcaaagatattgtattaattcagttaatcatgcaagttggaaacattttaagtattggttttgaaaaagcctatgcacttcaaaccgatttaaaccttcctacatctgagattatttcgacatacgtatataagaaaggtttgattgatggagattatggattttcaaccgcagttggcttatttaatacggtaatcaatgtcatcttattaattgcagtaaataaaatcgttaaaaaaatgaacgatggaaagggaatttaggaggtgtgagtatgaaggcgaagagaaaaagtcaattttccaaatatggccgacaagataaaattattttatcgattggatattttttaattgcattgtttgtacttgcaattattgtgccaattttttacatcatagttgcatcttttatggatccggtaacattacagaataaaggaattacatttgatttttcaaaatggacgataacagcgtatcaaagggttatgtcaaatggagcaatctggattggttttaaaaacgcagttatttattccgttgtatttacagtagtatctgttgtggttacattacttgccgcatatccaatgtcacgtacggatttcaaggggagaaaattatttaatgttatttttgtaatcacaatgttttttggcggaggtttaattccgacatacttattgatttcaaatcttggtttattagacagtatgtgggcggttatccttccgggtgcatttagtgtatggaacatgattattgcaagaacgtattatcagggaattccgggagagttaagagaagcggcagaagtagatggggcaaatgagttggtattcttctttaaaatactgcttccggtttgcacaccgatcattgcgacaatcgcattgtggcagtttgttggtatgtggaacagttactttgatgcaatgatttatttaaatgattctgcgaaacagccgttacagttagttttgcggtccattttgattcagaaccagccggaatccggcatgatttctgatatgcaaagtaccgcacagagggcacagcttgcagagttattaaaatatgcaacaattattatatcgagtctgcctcttttagtaatgtatccatttttccagaagtatttcgatagtggaatcatggcaggttcagtaaaaggttgatgtaggagggtaaagatgaaaaaaagaacgaaaaaagtatggaaaagaacagcagctatggcattagcagtggcaatggcagcaacgacagttactggatgtggaagtggtaaatccagtgcaaaattaaatgatggaagctttaaagaagtggatgcgtctactctggaatttccgttaaaagagaaagcaactttaaccggaacaattagttatccggcaaatacagaatctgaaccgaataagagaacgatttttaaaagacttcaggaaaagacgaatgtagaaattgactggacggcgattcaggcagatcagtggagtgataaaatttctctggaaatggcaaatacaaaaaatatgacagattttatcttttcagcgggattcagcgataatgacttgttaaaatatgccaaacaaggtgtaatcattccgttggaagaatatattgacgcatatatgccgaatttacaggcagtttttgaaaaatatccggaatatcgaaccatgtgtactgatacagatggacacatctgggcacttccatggattgaacagcttggaaatgaaaagacagcaattcagacaatcggaaatatgagttttattaataaaaaatggctggatttcttaaatcttaaagttccgacaaccgtagatgaatttgaacaggtattaattgcgttccgcgatcatgcatctgaaattcaggcagagtttggaattgatggaagcattattccgatgtcttgcattgtaaatgatggagaccaggatccgagtttaattatcaatggctttggagaagggtatggagatgcagataaaacaagacatattgcagtgacaaatgataaagaagtcatctgttctgcaacacaggatggatacaaagaaggtattgaatggctgcacaaattgtatgaagaaggcttaattgatacagaaagttttacacaggaatggtctacttatgtagcaaaaggaaaatccggacgttatggtgtttgctttagctgggatgtggcaaatattgataacttagaagactgggttccgcttccggcattaacagcagatacaagaaatattactcctcagaatggttctttcacaagtggatttgacagaggaagatgtgttgtaacagcagtagcagaaaatccggcacttgtttgtgcatggttagaccagatgtatgacccattccagtctccacagaataactggggaacttatggtgaagacgatgactttgatatctttgaactcagcaagaatgcagagggtggagaaatgctcaagcatgcaccgcttggagatgcttcaccggtagaagttcgtgaagcagaatcagttggaggtccgcttgcagtattaaatgattactatgatgtttatgtgacctgcccggatgatgcacaatatcgtttagactggattaaagaatattatacaccggatatgaacctggattatgtatatccaaatgtatttatgaatcaggaagatacaaagaaattgtctgaccttcagactgatattgaaaaattaatcaatgcaaacaaatccgattggattatgaatggatttacagatgatgactggaaccagtacttaagtgaattagacggatatggtctggaagaatatctgcagattttccagaaatatctggatgactattatgcagatagtgccaaataaagagaaaagataaggcgagaggctgcgtaacaaaactgcgcagtctcttttttgaaattttttttggaggaaaaggaatgattaacgataaattaaaaaaggcgagagaatatgaagtacggaaagaaaaagaaattgctccagataaaagaccggcgtttcacctgactccaagagtcggctggatgaatgacccgaatggattttcttatcataatggagagtatcatttgttttatcagtatcatccgtatggtacaaactggggaccaatgcactggggacatgcagtaagtaaagatttattaaaatgggaatattgtccgacagcacttgcaccagatgaaagttatgataattttggatgtttttcgggaagtgcggatactttggatgacggaaggcagattcttatgtatacaggtgttcaaagcacaaaagatgaagatggaaaagagattgtgtttcagactcaatgtattgcagttggagatggaacaaattttgaaaaatatgaaaaaaatccagtaattactgcagatgctttaccggaaggcgcaagtaaaattgatttccgtgacccgaaaatctggaaagaaaaagatggaacatttcgctgtgtagttggaagcagaccggcagatggaagtggacagatcttattatatagcagcaaagatggattttcctggaactttgaacagattttgattcaaaacaaaaatcgttttggaaaaatgtgggagtgcccggatttctttgaagtggatggaaaatggctgttgatggtcagccctcaggatatgatgccggtaggcctggaatatggagcaggaaatggaacattatgcgtagcaggtcatttggacgaaaacaaacatttggtagaagaatatacacagtcgattgattatggaattgatttttatgcaccgcagactgttttagcaccggatggaagacgtattatgattggctggatgcagaactgggatacctgtggagtacgggaagatgacatgaaatggtttggtcagacaagctgtccgagagaaattcagtttgtagatggaaaactgattcagaatccaattcgtgaattgagcaattatcataagaataccgtttcttattcagaagtgcttatatctgactgtatttctttagaaaaagtcagcggaagaatgattgacctggaagtagaaattaaaccggaagatgaagaaaattgttatgataaatttgtaatccaatttgccaaaaacgagagcttccattcggatattgtattttatccaaaggaatctgttctggaaattgaccgtagctggtcaggtatcagaagagccgtacagcatcagaaaaaatgtaaagtggcagataataacggaagtataaaattacgagtgattcttgacagatacagcgtagaagtttttgtaaatgatggagaacaggcaatgtcaatggcagtatttacagaacaatgtgcagatgaaatttgcttttatgcagagggaaaagtgaaagctaatgtgacaaaaagtgatttggaattttaaaaaagagttgattttagaaaaattttaatctaagaaagctgggctaagaaaatgacagatgtaaccgcattgggagaattattaattgatttcacagaaaatggaatcagtgagcagggaaatccaattttagaagccaatccaggaggcgcaccatgtaatgtgctggcaatgcttaccaaacttgggaaccagacattatttatcggaaaagttggaaatgacagtctgggaaagatgctaaaagataaggtaacagcactgggaatagatacaacttatctgtatcaggatgagatagtgcatacgacacttgcttttgtacatactgcagaagatggagacagagaattttcattctatcgaaatccaggcgcagatatgatgcttcgtgcagaagaagtgaatgaagaagcaataaaagaatcaaaaatttttcactttggaacgctttcgatgactcatgaaggagtacgcacagcaaccaaaaaggcagtggaaacagcaaaacaaaatcaggttttaatttcctttgacccgaatttaagagagccattgtgggatagtttagatgaggcaaggaaacaggtttcttatggaatgagtatgtgcgatatcctgaaaatttcggataatgaaattgaatggtataccggagaaagcgactatacaaaagcagttgagaaaatcttggaaaactatcagattccgctgattctggtttccatgggaaaacagggaagccgtgcatattataaaaatcagatggtagaagtaccggcgattcttcagaaaaatacaatcgagacaacgggtgcgggggatacctttgatgcctgtgtattagactatattttaaaacatggactggaaaatttgtctgaacaaagtttaaaggaaatgcttacttttgcaaacgcagcagcgtcgattgtcacaaccagaaaaggggcactttgcgtgatgccatcaaaagaagacgtagaagaaattttgaaaaaataagaaatgagccagcaggagtttgaaaacgtgttgagcagagattaatcgaaaaattttgacaggtgaagtctgaaaaaaaacaggagaacaataatgccaacgccacataaggatgttttggtttaatgcctatacggtgcaactcagaaatgggttgcaccgtttttcttattatgcgataaaacgaaaccgctgaggatttttttgcatttcttccatcattgcaagaatttcttgttcagtcggaatatcaatcattccaacagcagtgaaatacacatcaacttttacataacagtgaccgctggatttatcgttattatgaacttcaattcgttcaataagtgtatttacaagcgtgggtgtaagttccttaatttctgtaatttcacggagagtatgtagcaataacctgaggtcggtaactttctgtcctacatcatctaatgccgctttccattcttctatttctgtctgtaaccgtttttgctcacactcataattttgaagcaatttggaaaagcgttcatccgaaaggattccggcagcgttttgctcaaatactttctcaattaacttgtcaatttccgatattctctttccaccacgctcaattgataatctgagttttttattctccgtttgtcgtacaagatttgttttcttggcaagcatatacaaaaatgcggactcgtagcactttacaaaatctgccaagctccttatagattcaagtacaatctgttctaacgatatatctctgatatagtgaatttggcattcacctctgccgcttttgtaatttgagcatcgccaaaattcttgatttcgtttaagacttttcgctgcataaaagtgtaatttagctccgcaatcaggacaatataccaaacctgaaaacaagctttgtcttcctgttgctgtaggtcggtggcgatgttttctcaattcctgtaccctaagccactgttcttcagatataatcggctcttgcatattgggaataatttgatattcttcagtaggattatgaattaccttatgaaccttatagctgacagtcgtgctttgaagtttaccgcacaaccggtgtattgcctgttttcaagaatatttacaacagttttctgatcccatttgcaagaatcgcaaggcactttctgtgtgttttttttccgatactttcataatatgccgatggaataagtatattttccttttctaactgctttgcaatttgtagcggtcctcgacctgcaagacataaagaatagattttgcgtacaatattggcagcgggttcatcaattatccattgttctttgttatctgggcttttcatatatccgaacggaactgttgtagaaacacgcttaccatgctccgctttggattgccatacagcacggattttcttagaggtttgtgcagcataccattcattaaaaatattgtaaaacggaagcatttccataccgtcaccggttgtgctgtttacattttcctgaatggaaataaatgtgatacctaaggaaggatatacaatttgtgtgagtcttccggcttcaacctgttctcttccgaaacaggaaaggtctttaacaataatcctacaaattttaccttcctcagccattctttgcatacgctggaagtcacttcgttcaaaacttgtaccggaaatcccgtcatctacaaagaacattgtatttttgtagccgtgatttttacaataatcaagcaagatttgtttctgattacttatactgtttgattcatcatcggatacccttttatctttttcatcctcgacagataatctgcaataaagggcagtgatgagctcatcgtttgtttctgctgtcataattttacgctcctttccgacaacaggacataacaaagatatatttattttattacgccctgtgtcttttggctattgtatgaatatcaaattggcttttcaggcaatatcagtttctgaaattgctgaagaacattttctctgccattgggattaaaatgtgtgctgacttcgtaagttgtattgcctattttcataaagaacggttcatcattcttttcaaaatacggtgcatatattgatttgtttttatctgtcatcgttcatccctcctgtttctttctctttgcttctgccatttttcgagcagagatattattgttttctgcatatcggatttggtgtagtttttcggaaaatatttgcgtatatcttcttccataaaacgaacctgttctttttgattgggcttttcttcacacaaaacggcaaacacaacatcggttgaatatttgccttattcactgaattttctcaatcgctgtgcttgtgataatgacggtgtagcgtctgtaaattcgatttggtcaagcaatattctttgctcatattccgatagatatgaaatctcaaccgcaggagtaaaggctaaccgttccttgtccacaagttttaagagctcaggtattaagtatgtcaggcgaatatatcgctgtacttgtctgccactttctgtgtcagatatgttatctcttgacttgtggacaacttgtccataagtttttccctgatgctttaaggcttctaatttcattttgtaggcaaaggatttttcgcttggtaagatatgttcacggtgtacgtttgaatccaccatttgcacaatcgcctcatcttttgtcagttcttttattatcacgggtatgcttgttacacctaatgctttgcaagcttcagctcgtctgtgtccgctgataatttcgtatttaccagccggaaaaggacgggcaattatcggttcaagcaatccattttcttttatgctctctgttaattcttgttgctcaattccgcttctttccttaaacggatgattttcaaagggaacaagcgagtctatatctattatctgtatcatttggctatctcctatatattttcttcttcggcaagtaatgtcttactctataagtcttaataccttctgttattcggaaatcaagaaagctgaaaatcagaattgttttagatagataatgcttggctttccctgaccttgtcttttacgaagaatcaaatccgcagtttcaagttcagaaaacaacttacatattttttcgtgaccgaaatgcagtttttcctgagcggattttattgtgcaatattgatatactctgccttgtttatctatccagccgtttttgacggacagatacattcggtcaagtaaaagtccgtacagcattttggcgtctgttgaaactgatttgtacttttcttcaaataacgctttaggtactttgtagaatgcaaagtttttggcattcgatgttttgaaatatctgttcactgtgttacctccgtttctgtactgatttggtgccgaaatcggcaattctttcgcttatatgagcttgaaattctttgtaagtgttatttatcatcttttgtaattacgctcctttttgccttgaatttgcggcagtaaacaataatgacacgataactttgtttgcaatcgctatgacattttctgcaaagcttgttgtatgttcttctacctgtattgggggttatgaaaaatttccattcttgttttgctttctttgataatctcggcattataaaaactcctttcactcatttggacaaagggtgccaaaatgcacacccaaatcggataattaaaaagaaaaatacttttcagcgcataaaccatcagggggttccttgaactcttataaaatttattccttcacttattaggaatttctttgtgttttgcccccttgttttgtaaaaataaagacccatctgtaaaaaagtacagatgggtagaaatccatattattttctgctataataatgctatctcatcgacatagaattattaggagatgaaacatgagttattcagacgaaataaagaaaattcgtaaaaaatgttttctgtctcaagaagcttttgggagagaaattggagtttccttttcatcaataaaccgttgggaaggtggaaaaagcaaaccgaatatggctgctatgaaaaaacttaaagatttttgtgatattcatggtattgactttaccgccttggaagaacaatggaacaatttgggaaaggacaactaaaattatggcaaagaaaaagacagaggatacaatcaatctcgattcaattctttttaaatgtagagacatcttacgtgcagcacgtaattcgggttcattttttgaaaaacgtgatatgatgctgacactggtatttttaagatttatcggagaaaaatatgaggatggtatcgaaaaattacgccaaatcttaattgaacaagggcttgatccggatgatgaaaacattcgtgcagcattctttgatgatgccacatttgcagatggcacatataatctatcgcctgaggcaagatggtcaacaattataaatacacctgctcccaaactgaatgttgcattagacaatgcacttcatagtattgctgccagttctaagcaattaaaagggtgctttgtggaaggtacatttactacacgcaatcttgcaccgaatgatatcaaaaaactgattgatgaagtcaataaaatcagccataagaagttcggagaagaaaaagaccttattggtcgtgtttatgaatattttctgaaagaatttgctgttaatgccactaaagaagaaggtgaattctatacaccgcacgatgttgtacagctaattgcaactatgattgaaccgtatgacggcacgctgtatgacccttgctgtggttctggtggtatgtttattcaaagtgctgcactcgtaaaatctaaacaaggcgatattaaccgtatcaatgtatatgggcaggaaaaagaacctgcaacatatcgtcttgcaaaaatgaaccttgccttgcgcggcatcagccataaccttggcgaaaccagtgattccagctttctgaatgacctgcacaaggggttgtacttcgattacattatggcaaatccgccatttaacctcaaaagctggtatgacagtaccttggagcatgaccctcgctgggcggattaccagacgccgccggagagcaacggcaactatgcgtggattctacatatcctctcgcacctgaaaaagcagtccggcgtgtctggtttcctgcttgccaacggcgcactgaacgacagtgacacattggaaattcgcaaaaagctgatccaaaatgataaggtggaagcaatcatcgtcctgccgagagaactattcatcaccacagacatcagcgttaccctttggattttgaaccagaacaaaaagggcggtagctaccacggcagaaatctgcgtaaccgtgaacacgagattttattcatggacctgcgtagctggacggaaaacccggtaaagggcgagaacaagaagaaagtcctgctggacagcactcaaatcggaaaagccgccgacatctaccacacatggcagagcgagggcacggacggcagctgctatgaggtgccggagctgtaccgcagtgtgggtattgatgagattgagcagaacaactgggcgctgaccccgagcaagtatattgagttcatcgaccacgatctggaaatcgactatgaaaaggaaatggctcgtatccagtcggaaatgcaggaggtcatgaagcaggaaaagaaatcccagcagatgctggaagatgcattcagggggattggctatgggattgagtaaatataaattaggcaattgtgtcgaattatattccgaacgctgtaacataccaaatcttacagaatgggatgtgtctggcgtaaatagggataaggagtttttcgagccttcaaagcaagtcggcgaaaatacaagtaattataaagtggtgccagtggattattttgcctgtaacttaatgcacgtaggtagagataaagtgctaccaattgccctgaatcatactaacaaagaaaaatatgtgagtccagcttataccgtttttaagattaaggaaaatgctcagattctgaaggagtatttctttataatgctgaaatccaatgaacaggatagatatttctggtttcatacagattcctctattagagatggtatgtcgtgggaggatttttgtgaccttgagattagcattccgccgcttgtcatccagcagaaatatgtagctgtctacaacgccatgcttgccaaccagcaaagctatgagcgtggattggaggacttgaggttaacttgtgatgcgtatatagaccagctcaggaacaaatataaatcacaaaaacttggagcctttatttccatgtgtgaagaaaagaacgaaggactgcaatacagtattgatgatgttaaaggcatatctattgaaaagaaatttattgatacaaaagccaatatggaaggtgtgtcgcttcgcccgtatgcagttataaagccagacgaatttgcctatgtgacagtcacatcaaggaatggtggtaaaatttctctggcacacaataatacgcaaaatacttatatctgttcttcttcctatatcgtttttacgataactgatacagatacgctattgccaagctactttgccatgctttttaggcgtagtgaatttgaccgttacgctcgttttcattcctggggaagtgcgagagaaacatttgattgggaagaaatgtgtgatgtggaaattcccgtaccgcctatagagattcaacaagatattgtgaacatttatgaagtatatttagccagaaaagaaattaatgaaaagctcaaaagtcaaattaaggatatttgtccaatcttaattaaaggttctattgaagaatcaagtagatgaaaggaagtgtgacgtatggcaaagctgaataattataacggtcgctattgcgagtcggaatatgaaagtgctttcatcgcttttttgcagtcggttggttggacgtatctgccgggaaataagattaaacgctgttacagagacgtgcttattgcagatgatttcagagcatttattacaaaagcaaatacagacttgttggaagaagaaattgagcaaatttatgatactgttcgccttgtcggtgcagagagtgattttgccactttgcataaggtctataaatggatggttgacggtattcaattcacaccgcaaagtggtttaccaatacaggttactcttattgattttgaaacaccagaaaacaatatatttcatgtagtaaatcagctaacagtagactatataaataacggacaacgtgaaaaccgccgaccggatgtgcttttgtatgtaaatggcatgccactatgcattatcgaattaaagaatcctgccgattctcattctacaatttatgacgcatgggagcagattaccattcgctactggcgtgatattccgcatttgctacattattgccctttagcgtgtatctctgatggagttaaaacaagattaggaacggtacgcacaccttatgaacatttctatgcttggagacgtgcaaacgatgctgataagatttctaccatgccttttgcagaaaccgaaactatgattaagggtgtgtatgcacctgagcgtttcttggaaatattccgtgattacatttattttcaagatgaaattttcgattgtgatgaacgtgaaattgtttgccgttatccgcagttctttgctgcaagactgcttaaacagagtattataaaatccgttatggagcaaacaggaaaaggcggtacatattttggtgcaaccggatgcggaaaaacatacactatggcgtttcttgccagacagctttcacttcgctgcactgatattcctgaaattggctctccgactatcgttatgattgttgaccgtgatgaacttcaggaacagggaattaagctatttgccaagagcaaagaatttttaaacctcggtgaagtttctatagttaaaagtaggaataacctcagacaagaacttggcagcagagaaagcggtggcttttatatttgcactatccagaaattttgcgaccgtaaggaagataaaattggtctcattaatgagcgacataatattatttgtttttctgacgaagcacatagaacgcagttggagcattcaagaaaaattcagtttagtaaagatgccgatgaaaacatgaaagctatggtttctaagccatatgcaaaggtgttaaaggaagcatttccacatgctacatttgttggatttaccggtactcctattgcagaaacttaccaaacttttggcgatgaaattgaccgctatacgatggaccaagctgttgcagatggattaactgtatctatcaaatatcatccgagaattgcgaaagtccttttagataccaaaaaagtcaaagaaattgagacttattataaaacttgtgctgatgatggtgctaccgaggaagatattgaagcaagtaaaaaagctatgagttccatggaaattattcttggagagccttcccgtttggaacgtcttgctgtagatattcatgatcattatgtatctgcttgcgataaagaacctgacagaatacaaaaagcgatgattgtttgttctaacagaaaaattgcttatgagttactcagaaaatttagagataaatatccagaatggtttgaagaaaagaaaattcccgatggcatagaagctataaaggaagaacttgatgaattaaaacctatgccgtttatggctatggttgccagtgttggcagcaacgatgagaaagaaatgtataattaccttggcggtgtaaaaaatgatagacgctcaaaggaattagatgctgcctttaagcaggaaaaatctaacttccgtatagttattgttgttgatatgtggattactggttttgatgttccaagtcttacgtatctatataatgataagcctctaaaaaaacatctgcttattcaaacaattagtcgtgttaatagggtttatccaggaaagaaatttggtatggtcattgactatatcggaatccgtgataatatgcgtgaagctatgaaaatttatggcggagatacatctgttgcacccaccgaggatgatgtagaacaggctacccaagtttttagagaagaacttgaaattttaaagactatgtttaccggatacgatttgaaaccatttttaaatccgaacggagattctgtagaacgttattgcttgcttgccaaagctgcggagtacgtgttttcttctacagaggaattaaattctgaaggtaaaaacggtacacaaaaggtatcatttaaaacctattttttaaagactgttagaagagtgcgtcttggctacgatattgctcaaccatctggcgatttatctgacagtgaatccgctttggcacaatgctttatggcaattgctggttttgttcgcaaaatgagtggtacaactgagcttgatacagacagtatgaatcgtgctgtttctaaaatggtcgacgaggcattacgttacaatcaagtggagagtgtccttgatgctggggaggaagaggatatctttagcccggagtattttgaaaagctttctgatgtaaaaatgcctgccaccaagctagagctacttataaaaatgattcgcaaacagattaaagaatacagtaagattaacaagattgctgcaaagacttatcaggaaatgcttgaagaaacgattgctatatatcatgaaagacgaaaacatattagtgcagaagaagctggagctacacaagaacaggcatctgaagatattattaaaaatgccacggaacaagcattacagatactccgtcaaatgaacgaaagccgtgaaagtttccgtaaaattggtttaacctttgaggaaaaagcattttacgatattttagtatccttacgagaccagtataattttgaatatggcgaggataaagacattggtggtatgattgtaaatgatagatgtaaaagtcttgccaaaaaagtgaaagagataattgatacaaaatcttctttttctgattggcttaacaaccaaaatgtacgcaatcagctcaaacttgatattaaaatttgtctcgtaaagaacggctatccacctcaatatagtccagaggtttttacaaaagttatggaacaagtagagaattttgaagaaaattccgatatgcctttggctactacttatacatttccacaatctcgtactgtatctatggtagcggaagatatcattccatatggaaataaatcggagaattgatgaggaacggaaatgaaagcaaaaaaatggctaactattattacattggttattacagccttgtcattagttcttgcctttatcattggcaagaatagtaattgtataacttatgacatatctatggcgattttcggcggagctgctcttggctttataatgtcattaacagaatattatgttgaaagacgaaaagcaatggaagaattttggcttcaggcaaccaaggtattaaatgaattaaaaaagataaaatatcttgatgtggatgcacctataaatttaattgttgatgcaatacatgaagacgattcaaatgcattgaagaaaaaatttcatcttttgagtgatgaagaaaaaatatcagttaatgcaaaggaaaatttgatttcttggtataaagaaaacattcccattccttttgatgaaaatactgataataacaaggaattaactcagctatatgattcgaatatggctggttacaaagaagttttccttcaatgcatggacagctatcgagaggcatcaatggttaaactgggaaatcttgacaacgcatacgggaacttggattttattatagctaataaatgtattcgacaaaaagcatatgagcaaatatatgataaactgagaaaaattgtttatcagtttcagaacgaagcataccattttaatctattaaaaaatggaagtggcaatttttcagtatgcattttaaaagtatctgaacttaatcaggaatactttttgtcaaaagaggaaaatctccaagggtatactaatgtttcaatatttcaaaatgtctttgatgatattgatgcctcattagagaattttagatgcaaaatatatagaatcgaatatgttgaaccaaaagcaatacctgtttccggtaaaacatttttcaacaacaacgaaaaatagaattcgtattttgaaatttggtaatggagtgtgcgtaatcgctaagcaaaaattattatccgggtattagggtatccctaacgaatgtcttaccgtttggataaccaaatggtctgctcgctaagattatacattttaatcaaataaataaaattaaggcacagcctacggtatttttctccgtaagttgtgcctttttctcatctataaattacttgttcattaacgatttctgttgctcggttgcgaatattattcatctttcgcacccacaacatcatatttcctgctttgagtttttctgtaacttgctccttttcgacaagtgattttactgtctgttcaaataaattctctgcttgacactcgacaccgtcaagataatcatagagcctttcactcgtcagaagattataatatcgcaccttatgcctctgctttaggtattgcttgtgacggtttgcgcatacgcctaaatgtatttcttcttgcttcttggttcttacgcaagggataagataattgccttgctgttcatactgcacattcatggtcagccctcctgataaattattttgaaattctttttctttgcaccgataaactctacaagcacatcatcgactgcatctgtatatctgccctgtgcgattaactcgtttctcaggttatttagtgaattgataattaaactgtattcgttattggtcagtgcaagatggtatttgatagttctcattgcgaatccctccttgactatattctactcgactgatttttaaattgcgaatgtgtggattttcaaagcatagaaaaaagactctgaccttttacagtcaaagtctttctctggtgcgccttgcggcgcacgtttctaatgggtgaaagtccctaatccaccctagtagtgggaaggatacagccgagaccaagggtgtcctgttcatagaaatgattatgattaacgtgaggggaatctgaaggaaggtggaggcaaatctctggtctgacgaacagaaatcacataaggctattattgaggacaagactgccagacaagtcaaagtccaataactactcggaattaatgatagtaaatgtggcagatatatggagagaaagaaacgtgtggtaccaagggaggtctcgtcagcggatggaaacagagtaagaaatccgtcagtaacaacgaatgacgagaagtcagcagaagccatagtaaactgatggttgcaaacatcagcaaagggctgaactttaggagacacaagcaatgaaagtaactgaaagtggatttaataacagacaacttcatatggaagactatctgcaaatggtatctgcggaacagaaagagtatgcagaagtgttagaccaccagaagattattgaaaagagcggtgtcatcacagattattggacggacaatcttctggatttgattttgcgaaaggataacctaaatgcggcttataagaaagtaaaatcaaacaaaggaagcggtggaatcgacggaatgcaggtggatgaacttctgccctacctgagagaaaaccaggaaactttaatccaagaaataagggatggaaagttcaaacccaacccagtccgaagggtagaaatacccaaagaaacaaaaggcgagtttcgcatgcttggagtgccaacagtggttgacagagtaatacaacaggcaatcacacaggaactcacaacaatctatgaggatcaattctcggaaaatagttttggatttcgccccaaaagaggagcgcacgatgccctcagacaatgccaagagaatgtaaacgaaggttacgtatatgtagtggatatggacttggaaaagttctttgacacggtatgccagagcaaactgatagaggtgttgtcacgaaccatcaaggatggcagagttatatcgctgatacacaaatacctgaatgcgggagttatagcaaatgggatatttgaacgtacagaaataggaatgccacaaggtggaccattaagtccgttactaagcaacatcatgctgaatgagttggataaggaactggaacgcagaggacacagatttgtccgatatgcagacgattgcatgattttctgcaaaagtaaaaagagcgcagaaagaaccttgaaaaatatcattccattcatagagggaaaactttttctcaaagtgaacagaaagaaaacgacagtggcacacgtcagcaaagtaaagtaccttggttatagtttttacagaaataagggaaaatgcagatttagagtgcacccgaagtcagttgcaaagatgaagaataaaatcagagaactgacagacagaaataatggcatgagcaatgcaaaaagagaagaaaaatatcaacaattcgtgcgaggttgggtaaattatttcaaactagccgacatgaaaaatcttctcaaagatacagacgaatgggcaagacgcagaatcagagcggtctattggaaacaatggaagaaaatcaagacaaagtaccgaatgctgaaagcattgggaatggatcattggaaagcgaaagaactcgcttgcagtagaaaaggatgttggagaatggcgcaagtgctaaaccaaatcttttcaaacaaaataatagccaagttaggatatatacccatgcttgactattatctggtagtttgtgaaaactaaggaaccgccgtgtacggaaccgtacgcacggtggtgtgagaggtcggctaatcaacaatggttagcctcctactcgatttctttgcaatgccctataaagttgtattcttataatttttaagttactgccttatgtggtgttagcaaaaagtttctcctgttttttttgcaagaataagccaaagtatggtatgatataggcaggtgactaaaaaagagggattgagcgaaaaaaatgaaaaaactatgggattgggtgaaggatgtttgggtatattcaggtctgtcaaaagaaaactatgaaaatatccagcaaagtgtggcgcataaaaatgcaagattgttaaaaaatgcgattcgttcttttgaagtgctcacaggagtattattaattgcagcgttctttttttcacaattaaatgcgttgaagagttttttgattcttacttttatcggtatgatgatgatggaaattatagtacgtgtctgtgatttgaataattttagaacacttcggagtgtctgttatgtatttctaagtacagtttatttatttacagcgatttcgggtacagttggaagtccgaaacagagtgcaacttcatattttattttattgtttgtaggaccgcttttgtttattgacaagccatatcggatggcgttgcttctttgtattatgacggtgatttttcgatctcttgcactgcattataaagagccggagattgcaaattttgatgtatcaaatgcaatctgttatacgatacttgcgattttattatatcttttgaccagtcgtaccaaagcagatgagcataggcttagatgggaaattgctaagcagagagatacggatgagctgacaaagcttttaaccaaaaatgcggtagagagaaagataaaacagtatatggaattaaatccgtccaagccggcaatgatgcttgtaattgatttggataattttaaacatatcaatgacacgttcggacatgtttatggagatgcagtactacgtttgatgggagaatgtattagaagtaatttcagagaagaggattataagggaagatttggcggagacgaatttgtagtatttcttccggatgtagatgataagcagcaggtagtaacttatgtcaacaacctggtagaaatgatgaaaactcgtgtcagaacaccggagagtgcaaatccggtacatggaagtataggaattgcgctgtatccaaaacatgcctctacttatgaagaattgtttaaaaaagcagatgaggcattgtatgcttcaaaagaacggggaaaagaccgctatacattctatatacccaaagaagtattaaaataaaaatcgaaaaggatttggtgagttattatggaagaattatatcaggcaattgaagaaaaaataaaagcttcgggttatccgagagcaatttcaggagcagatgtgtacgatgatatctgtgaccagattgaaggaaaagagaatggaagttatttattattatccaaatttgaggatgatgtaatatttgagtaccatgtgaccattcaggatgaagaatttaatcttgggattttgaccatgcgtactccggaaggaatatttgaagctgattttgataaatagaaagagtggctgtcgagttttcgacagtccttttgttttttcatagcgtttgtcgaaaaaacatagtataataaaaaggaaagctatttttaaccgaggaaaagagggctcaaatgggtgaaattggacagatttttttaaatctgggggaatattccggaccaatattaatcgggctgctggtgggagtttggttgttcgggaggtttctgaaattaaatttaaaagaaaaaagaaaaagaaatcttcaggatgcaagagatattattattctgaaatagaagagggagaatcggaaatccatattatgagccaggtgaagcagatggatgttatcctgtattgcacaggtggcatccattttgtttttgcctgctattactatatatactatatgcgttttgtacctcattgaacctctgggaaagactttgacatctaatcatgggtatgatacactgaacttaactatgggtattgtgtcatggtatggcaaatattaatagtagaaacttaatatacgttatatatttagtacaaacacagcaaaaggaagtatcgaatgtacagctgattttgagcgtacatgaaactaacagaggtgaaaatattggataaaaaggaataccgtgcgagactggatgagattaacaatctggtagagaagcaggattacagagaagctctgaatgttgtagagacgattgagtggagacgggtaagaagtgcaagaactctttgtatggtaagtgaaatctacgaggttaataaacggtatgatgacagtctcagactgcttctgctggcttatcagagagcaccgagcggaaagctgattttatatcgtctggtagagttgtctgtaaagatgacagattatgaaagtgcagttaagtactataatcaatttatgaaactctctccaaatgataacaaccgttatattttgaaatataagatttataaaggaagaaaaaatccgattgaggatcagattaaaatcttagagaaatataaagcaagtgagtatacagaacgctgggcttatgaactggcaagattgtatgcaagagccggcatgtacgataaatgtatcgcagaatgtgacgagatggttctctggttcagcgacggaaagtatgtaaagaaagctctggagctgaaaatgaagtatacggagctgacagatgcggagaaagaaaaatataaggaactttatggagagccgaaagcagtacgtattgcaagaacagcggcaagtgtaagtgcggcaactcaggcggcagcaaagatgctcaatcagactgcgcagactatggtaaaaccagaggaagcagtaaattcagttaaagcagaggcatttcagattccgaaaccggaggcgattaagaaagctgaatctggggcaggctcagaagcaaaagcggaagaggaagtaaaaccggaactggcagaacagccgaaaataatgaagatgccggaatttattaaaactccggaagttaaaccagattttgaaccacttccggaaattcaaatgccggaagaaatcaaaaaagaaatcgaagaagaactcgaaaagaaaaaagaggtagaagcaaaactgcaggaagaaacagcgaaaattgcagaagaagaacctgttaaagaatttgatttagaggcggcacttggagctgcggcagatgagatggttcaggaagaaaaaactgaagcagtagaaaacgaagcggaagcaaaaacagaaatggaagtgtcagaaggcgcaactatccagcttccgttagaagagataaaagcagcacgtcaaaatgcagtagaaaccgatgcaacggttgatttatcaaatgttgtagaagaagcaatggcggaagcggttgtgacagcggaggaagaaacagcagaaaaagcggtagaagctgaaactgaggcatcagaggaagaagtggctgaagctgagacagaagagccacaggaaaatgaagcagctgagtccgttgagacagaagagcagcaggaagagaaagtgacggaatctgctgaaccggaaccgattgaagtagaagaagcacgagagagtgaaccggcacagtggatgcttgaggagccagtggagtcagaagaagaaaatgcagagccggaagcagaagtagctgaagaagtagaaccagaaccggaaaaagtgcttcgtcatcatttgacagaggaagaacacagacgactctttacttattttgcaccaattccgggaatgaaagaacaggtaaaagaagctttggatatcgcacagaaatctgcgtgtgaaaagacttccaaggcaggaaatatgattgtaactggacgttccggttcaggaaaaaccagattttcagaaagcctgattaaagcactttgcaaagaacgccagatggaaggtgcaaaagtggcttacctgaccgcagaggtgttaaataaaaaagaccctgcatttattgtagataaactttcaggaggatttctggcaatcggacgtgcatctgcaatgactgcccaaacagttgagaatctttccaaagcgatggaatttaagaccaatcgtctgactgttattttggaagattcaaaagccggaatttatacattgaagcaggattatccggaatttatggaaaaatttgattcgaggattgtaattccggtttttaccaatgacgagctggtgtcattcgccaagacttatgccaaggaaaaaggctataaggtagatgatattgcagtacttgcggtatattctttgattggcgataatcagtatgaagatgacccagtctgcgtcggacaggtaagggaaatgatggatagtgcaattgcaaaagcttccagactgggtagacgtccaggtaaaaaagtggcaaaacgtcatctggatgtaaccggacgaattatgctgtatgaaaaagactttaacctgtaagatatcataacaggaacagtttgcagataaaaatatagataaaatttgcagataaaaatagagtctgcagataaaaaatatagatgaaaaagcagataaaaaagggagaaaaaaatatggcagtcccatatcttggaaattcaaagaatacgattgaagtattgcagaaatatgattttgtttttcagaagaaattcggacagaactttttaattgactcccatgtacttgataaaattgtaagcgcagcaggaatcacgaaagatgattttgtactggagattggtcccggaattgggactatgacccagtatctggcagcttctgccagaaaagtgtttgcggtggaaatcgataaggcgttaattccaattttggaagataccttaaaagagtttgataatgttcaggttatcaatcaggatatccttaaagtagatatcaaaaaactggcagaggagcacaatgacggaaaaccgattaaagttgtggcaaatctgccatattatattacaacgccgattatcatgggattatttgaaagtcaggttccgattgattcaattaccgtaatggtacaaaaagaagtagcagaccgaatgaaagttggtccgggcacaaaagactacggtgcgctgtcactggctgttcagtattacgctgagccgtatatcgtggcaaatgtacccccaaactgttttatgccaagaccaaaggtaggaagtgcagtgattcgtctgaccagacatgaaaaaccaccggttgaggtggctgacgagaaattgatgttccgcctgattcgtgcttcttttaaccagagaagaaagacccttgcaaatggattgaataattcaccggaattgtcttattccaaagaggaaatccagcagactattgaaaaatgtggatttaaagcgggaattcgaggagaagcactgactttgaaggattttgcaaaacttgccaatgcattttctgaaaagtgaaaaattcaagaaataaaatgaatacagaaaaataaatacagaaataaaacgaaaagccatcgcccagaatatccgaaactgggcgatggcttttttctataaatattaaaggaaggagagccggtcgtttgcgaccgacatatgaaaaagaaaatataaaaataatttttgttctttattatttttatggttttagtatattcgataaatgtgtgcaaatcatgttgaagttgtgaagaaatcatgaacgaaattcaaaacttttgtgaatgacagattttatcgtattttgttggaagaaaaattttcaattatcaagtgacgaatatccagaaaacgttcgacaccaatgcggattccccccatcagaccggaaatatcctgaagccgggaagggataatctggcatttacgattctgatgatggtgcagatagtcctgaatcgagaggttaatctgcggaatataattagaaaacgagctgttgagcacgaccagttcaatattaaacgtattaataatattgttgattgcaattgaaatatatttggaaaataattccatcatttcaagtgcttcaggaacctggttctgatagtcacggacaaaagcatctatcgtaacctgttcctgatgggtgagtctggcatattcttctaaaatcgctttctcagaggcatattgttccagacatccatgattcccgcatgggcagggtttgccgtcgggaaataaaattgtatgtccgatttctccggcatagccgtcctgaccacgataaagatgaccgttaatcataattcccataccaattccatcatgaatatttaataataccatgttttggtcataatgatgaaatgccgattcaccgagaacagacaggttcgattcattttcaacaaaaaccggaatgtgaaactctgattcaagcagtttggccagattagaatccggaagcggataataaggagtaaaaagaatctgattttgttgtacaacaccatagattccgatggtaattcctacgattttatagggacaatccccatactcaggcaggatatcatgaattatccggcacagatttttgtataaattatctcccttttggaacggatattcttttaaacggcagttttctccttttaaatccgaagttaaagcaataatctgagacggatgcacgtcaatagaaagtgcatatccgcattttttctgaaattcaagtaaaataggttttcttccaagagaagtctgagcgcttccgatttctaaaatcagatgctgttcaatcagctcctgaacgatattggaaatggtcgcttttgtcagatgaagctgctgagaaagcgcagcccttgagaccggtggatggtttacaagatattcaagcacctgcctgcggttattgtcgcgtatcatttcctgatttgcaatagccatgaaaaaaatccctcctttaagtgaaatgtactcttgaaaaatcagccgtaaaatcaaatacagaaagattcggagagtacattgcgtgtattatttatcataccacttttcttaagtggcgggcaagaaaatttgtataatgggtaaacaaaacgtaaaggggcagttgaacgcagataagcattctcacacttcaagtgcgcagagcgctaagcagtgggtaaggagtttgcttttggggttgattttgcaaaacgattaggcagaaaaaagtttcggataaaatttcttaatgaaaactttagatgcataaaaacagggagtgtgttatgatgagggtgaaactttgaaaggagatttttattatgaaactcaacaaaagaaaattagcgttactgatgacaggactgatgctggtcatgtctccggtcagtgtatgggccgatagagaagatgcaaaactggagaaaccttatgtatccttaggtgcagacttaagtgcaaatgaccgtgcaatcgtattaaaattgcttggtgtgacagaagatgacttgaaaaattataccgtaacaacgattaccaatgccgatgaacacaaatatctggattcttatctgagtaaaagcgtaatcggaacaagagccctttcttctgtactggtaaaaggaaaaactgacggaagtggaattaaagttacaacctacaacattacttactgtacgaccggtatgtaccagaacgccttggcaacagcaggaattgaggatgcagagattgtggtagctggtccttataatatttccggtacggctgctctggttggagcaattaagtcttatgagaatatgacaggcgaaactgtcagtcaggaaaatgtagacactgcgacaaacgaactggttgtgaccggaaaacttgcagaaagtgtaggtgattccgataaagcagaacagttagtcggagcagtaaaagaacaggttgtagaaggcagtgacaatggaaaaaaactgacggaagaagaaatcggaaatgtagttgaccaggcagcacaagagatggatgtccagctttctgatgaggaccgtcaggaaattgttgctttgatggataaaatcaagggactggatattgatgtggacagcttaaaagaacaggcaaaagatttatatgataaaatcgatgatttaggattaaaattagactggaatcaggaaaaagtacagggattcttctctaaaattatcgaatttttcaaaaatttattcagctaaaaacgaatagaaatagttccatggaacagttatatgggtaaaaaccgggggaagacgtctcaaaaatgtcttccccctttcatgttactcattttctgttgcgctgtatttctgaattgcctcatttagagatagcatacgctggtctaattgagccacaatcgtagcacattcctgtaagtctttactgatgtaatccggtgcatttccctcaaacttgtaataaattttatgttccaggcttgcccagaaatcctgtgcaattgttcgaatttgaacttctacgggaacatagagagtcttatcatagagatagaccggaacagaaaccagtagatgataactttgataaccgctctcttttggctgtttcatatagtcttttatgttctcaatgcgcaaatcattttgcttacgaataaaatcagcaatcagataaatatcagaggtgaaagaacagataatgcggattccggcaatatcgtttacatatcgaatcatgtttggaatatttgattcgtaaccatctttttttaatttttttacaatgctttccggagttttgattctcgattttacgtgttcaatcggattataatgctgaatatactgaaattcgtcgtttaagatatcaattttagttgccacctgttttaatgcggcatgataaagaaacatcatagtttcccagtcattgacatctccatattctctttcaaaaattgaattatttatagtatcacttccttttttgtcgcttctgtatagtatagcataaaagataaaagatgaatagaaagaaaataaaaaagagattttccgaaaaaggttgacagaagagaggggacgttgtttaataaaattattatattaaacgtttaagtaaaaaagaaggtgaaaaaaggaaaatggcgacgattaaagaaatcgcaaaggcatgtcatgtatcagtggctaccgtttccaacatattgaacaaaaagccaggtgcaagtgaaacgacaagggaacttgtactcaaaacagctaaggaaatggactatatgccaaattatgtggcgaaaaatcttaaaacaaagaatacaagaagcataggtgttatagcggaggacatgactattttcagtattccggatattattgacgggattacggaatactgtgaggaagttgattatcagattttacttacgaatttacggctgtataagaagtatcaggatgtgtattatggcagggaagattattttgaaagggtaaaacaggaaataaaaaagcttatggcaaagcaggttgaggggattatttatgtgacagctcatgagagggtgatgcattgtattccggatgacctgccgataccggcagtcatggcttatggatatacggaaagcaaaaaagtgccgtcgattgttgtggatgatgaacatggagcgtatgaggttgtctgtcatctgattcggcatggacacagaagaatcggtgtagttatgggaaaaaaggatagtcttcatgcacaggcacgtcttgtcggataccagaaagcactgcgagacaacgggattgtgtatgatccggaacttgttgcacagggagactggacaagagaaagtggatatagaatggcagatgaactgcttgcacatgatgtgacagcagtcttttgtatgaatgatcttatggcaggcggactttatgaccgactggatgaacttgggaaaaaaataccggaggaactttctgttgtaggatacgatgacagagagttatcaagttattataagccaccgctcacgacaatccgactgccgctgcatgatattggatatcgtgcagcagaagtgatgattgctttgctggaaaaacggattgtaccgcaggaagaagaagtgatttatcagatgccttgtgagatgttaattcgtaagtctgtgcaggactacaaattatagtggtacaagttgtgagaataggatacaagcaatgaaaaaaacagctttttgagactttttttaaaaggttttggaaagctgtttttcgttaaaatatacaaagaaaacaggacttgaaattgataaatattaggattgagagggaaaatgttgtgcagtttgtacatacttaaacgatttaaaaaaattaaaacatgtagaaaagatggaaaacaaagaaaaaatgagataataagaaaaaaaaagagattatagagatattaatcgttaaaaaataaaatttataagctttttattgtgtaaataatgtggtataaataagaaaaacaaacaagagcgttgtacaaaatcaataatgacagacaagattcgggcagattagacaaaaaaaggtcggaaataggaatcaagttcaaaagagcggaacatttaaatgttaaacgtttaattgaaaaatgtcagtatttgtcaaccaggtatcatgcagaagcaggaggcttctgagttgataaaattattaaaggaggacactataatatgaaaaagaaagtgttagcagcattattatgtgcagcaatggtaggaactacattggcaggttgtggttcatcaggcagtgattccggaagtgatgattccgcaaaacaaacaggtaaaaaagaaatggatgtagagggagatgacgttaccactcttaatgtatggacattcattgaaaaccatcaggatttctacacagatatggctgaaaagtggaacgaagaaaatcctgacagaaaagtaaaactggtattatccaacatggcttatgatgatatgcacaacaaactgtctctggctctggaatccggagaaggtgcaccggatgttgttgatatcgagttaggaaaattcccggcatttatgacaggaaacatcggactgaaagacttaacagatgcaattgcaccatacaaagataatgtagtacagtccagacttgacttatattctaaagacggtaaatgctatggacttccaacacatgttggtaccactgttgcattctataatacagaagctttagaagcagcaggaattgattacacaacaatcaaaacatgggatgactttaaagaagccggtatcaaatatcacgatgcaaccggaaaaacatttgcagcagctgaaacaactgcacagtggacactgaacctgatgttagctcagaaaggtggaagctacttaaaagaagatggttctcttgatgtaaacaacgacaagatggttgaagtattacagtgcatgaaagatatgcaggatgcaggtgcacttgctacaatcgctggtggacagcctgataatgaagaagcttatcctctgtttaatgatggagaggttgcagcagcaatcatgccattctggcagacaagccgttacttaagttacatgacagacctttccggtaaagttgcaatcgcagctcctccagtattcggtgacaatgatgccgttaagacaatcggtggtggcggtaccggtactgcagttgtagcatccggtgaaaatgcagaccttgcagcagacgtatttgcattcatcaaactttctgatgaagccaacgtagaagtatggaacgtattaggatttgaccctgtaaatacagaagtttggacacagacagatattacagaaaatccagacaaccagtatgtaaaatacttcaatacaaaaccatttgatacactgttagaagtacaggatggcattggcttattagactgttatacagatgaaaaaatgccttctattaacaatgtatttacgactcagactttaaatgatatctttgaatctggcgtagatgtaaaagaagcacttgatgaagcacaggatactctggaaaacgaattcgcagaataatcatttgtaagtgataagaaatgtaatataagaagagcgggatgtggggaaatcccatgtcccgctcttattagagagaggagtatatatcatgaacaaggtaaaaaaattcttttactcacagaaagccgctccttatgtatttattcttccatttgtattgacaattcttttattctggattgtaccgattgcaaatggtgtacttcttagttttcaggatgtactcaaagataaatgggtaggctttaataactattcgagattgatttcagataagatgttctacaaagcaatttacaacagcgtaaaatacatgattggaactttgattttactgattccatttccaatgttatttgcaagtctgttaaacagtaagctgatgaaaggtgcaaatttcttcaaatctgtttacttccttccggctttaacatctgttgtagttgcaggtactattttccgtctgatgtttggtgaaatggacaccgcactggcaaaccagattatcggtctctttggacattcaccaatcaaatggttaaaaggtgagtggaccagttactttgcactcctcttggttgcatgttggagatggacgggtgtaaatattctttacttccttgcaggtctccagaatatttcaactgatatttatgaagcagcatctatcgatggtgcaacaaagtggcagcagtttattaaaatttcattcccattattaaaaccaacaaccgtttatgtgttaacaatcagtatctatgcaggtttgtctatgttccttgagtccttcatgttatggaaaggaaataactcaccaagaaacatcggtcttactattgtaggatatctgtacagacagggtattgaaaagagagcaatgggatatgcgtgtgcagttggtcttgtactgttaatcatcgttatgattatcaatatgattcagcttgttgcaacaggaacattcaagaaggaggagagataatatggcagcagaagcaattggaaaaagccagaaaacaaaaaacagagtggcaaccgtgcttatggtaattttctttacgattcttgccatcttgattatcctgccgatttatgccattattctggcaagttttaaaccgggtaatcatcttcttcagtatggtttgaaccttgatttagacagtgcaagcatgacactttcaaactacgtgttactgtttaccggtcaacatgactactggatttggtttagaaacagtttattcttaactgttgttactgtagtattaaccttactggtaagtgctttcgtagcttatggttttgcagcttatgatttcaaagggaagaatttcttcttcgtattagtattgattattctttctattccttttgaagttatcatgcttcctttatacaaacagatgtcaacatggggactgatggacagctatgtagcagttgtactgccattccttgcacatgcgtcaacgattttcttcttcagacagtacctgcttggtacaccaaaatctctgattgaagcaggtcgtattgatggagcaactgaatacggaatcttcttccgtctgattgtaccgattttgaaaccggcattttccgctatggcaattttaaatggtatgaatgcatggaataactacatgtggccattactggttgtgcgttcttccagcaaatatacgttaacaatcggtttgaacacactgattaacccttatggagataactacagcctgttagtagtaggttctgtattctccattatcccaatctttattctgttcttatgcttccagagatacttcatcgaaggtatgactgccggagctgtaaaggaataaatacttaaaatatttacataattatgattttgaattttcaggaggattaaaaaatgagcagaagagcgaaaatggttctggataaagagttccagattgcaccaattgataagagaatttatggttcttttattgagcatttaggaagagctgtatatgagggaatctatcagccaggtcatccggcagcagatgaaaatggatttcgtaaagatgttatcgagttggtaaaagaactggatgttccgattattcgttacccgggcggaaattttgtatctaatttttactgggaagattctgtaggtcctgttgaggaaagaccacatagactggaacttgcatggagaagtcttgagaaaaatgaaattggtctgaatgaattttcaaaatgggcagaaaaagtgaattctgatgttatgatggcagtcaatcttggtacaaggggaatttcagatgcctgtaatcttctggaatactgcaatcatccatcaggaacaaaatacagtgatatgcgaattaagcacggagtaaaagacccacacaacattaaagtatggtgccttggaaatgaaatggatggtccatggcagattggacataaaacaatggaagaatatggacgtcttgcagcagaaaccgcaaaagcaatgcgcctgattgacccaagtatcgaactggtatcctgcggaagttctttccgtgacatgccgactttcccagactgggaagcaacgactctgtcccatacttatgagtatgtagattatgtttccatgcatcagtactatggaaacagagacgatgacagcaatgattatctggcacagtctgatgatatggatgatttcatccgtacggttatctcaacctgtgactatgtaaaagcgaaaaaacgtagtaaaaaagtgatgaacttaagctttgatgaatggaatgtatggttccattcaaatgcagctgatgatgatatcacagaaaatcatccatggcaggtagcaccgccaatgctggaagatatctacaactttgaagatgcactgttagtcggtttaatgctgattactcttatcaaacacgcagaccgtgtaaaaatggcgtgtctggcacagttagtcaatgtaatcgctccgattatgaccgatgcagcaggtggcgcatggaaacagaccatcttctatccatttatgcatgcttccaaatacggacgtggcgttgcactgcttccggttatgaacagcacaaaacatgcaactgcaaaacatgatgaaatcacagacgttgaatctgttgcagtttacaacgaagaaaaagatgaagtaacaatctttgcagtaaaccgtaacttagaagaagacgtagaacttacaacagatgtaagaagctttgaaggctaccgcatattagaacacatcgttatggaaaacgaagatctgaaagcaggcaacagcctggccggagaaaaagtttatcctgtaaatggcgatgagagaagcaaacttgacggcggagtgctgacaagcgtaatcaaaaaagcatcctggaatgtgattcgtctgggtaaataaaaaataaaagaagtaaatgaagaacgaattgtcgtattaatgtttgagaaaaatgttaatgcgatgattcgttttttgatttaaatgaaaaaaattatgaaacaaataactgtgatatacctacagaggcgagatgaattgttcaataattgggattgtgatataatgaaattgataaattagtgggagtttgtagtcagatacttttggaactgtgaatgaggcaaagtattagaaaattgaagattgtggagggtttattatgagtgagagagcagaaattacttttatgcagacaagattaatccgacttgcttcagaagaatggcatttaccgattgaacagattatttacttgttcaaaaaagtagatgttcttggatatatagaaaaaggttatgggattttccattgcgaaggtgatgaggcggtactggaagatattacggagcttcttgaaggaaaggggataaaagttaatgcttgaagtaaaagatggacttgttctctatcatggaagttattgtgaagtaaaagaaccagaccttgccaaatgtgcgaaaagaaaagattttggccggggattttatttaactacatccaaggaacaggcagaaaattttttaagaacttcaataaccaaggcaatagcaggcggaagaattgaagagggacagaattatggctatatttcgacttttgaagtaaaactttcgggaaaacttgagacacatatttttaaaaatgcggatgttgactggttacactgcgttgcagctcatagaaagaaaaaaatgttcatcgaagttgaacaggaaatgacaaaatatgatattattgcaggaaagattgcggatgatgcaacaaatgccaccctcacggcataccttgctggtgcttttggaatggcaggtgataaggaatcagatgatttctgtattaaacggttgttgccgaataaattaaaaaatcaatattgttttaaaacaaaagcagctattgagtgtttgaaatttgtggagagtgaaaagatatgtctgaagtaacaatatcaaaagaaaggataaactatacaatagaccttcttattactatggtaacggaagaaattgcagaagagacgggcagggatagaaaagaagtgctgatggattttctatgttccagaacaggaaaggcattatacgacgagaaaacaaagctttggtgcaatggaccatcgtatatagctgaagtgtatatggaggaattaaagcaaagagagattgataaatgagaagataaaaaacgaattgtcgtattaatgtttgagaaaagtgttaatgcgatgattcgttttttgttttaaatgaaataaataattgttgtatgaattaaggagagagacaaattgttctatcattgggattataacatgtaacgggaagaaagatggttattatttgccatcttttttctcgttctgataaaatttaggaggggtgactcgaaatggatcacaccctcctcttagttggaactatctattttccgacagacaatcatgagaaaatctcaccacaataaatgaaaactggatactagctatacgttatgtagtggtatacttaaggtgccgaataagatcggaaggggattggtgcttacaagcccgtccgacagactgattttcagctccttaggtgtaccactttttgtttccatcgggttttgatgaggacgcaggacagccaacaattaagcaaggagctgcatcggcttatgcgaaggaggtttgctttatggaagtattgtataagcggtgttgtgggattgacattcataaaaatatgatggtagcctgtatttttacgagtgtcagaaaaaaagaaatccgtcagttttcaacaatgacggaagatattctccaattagtttcgtggctgaaagaaacagattgtgagatggctgccatggaaagtacgggctcttattggaaacctgtatataacatattcgaagaagaacagataccgatcatggttgtgaatgcgcagcatatcaaaggagttcccggacgtaagacggatgtaaaagatgcagagtggattgccgatctggtacgccatggattagtaaaggcaagttacataccaaatagggattaaagagaactgcgagaaataacccgttaccgccaggaggtaattgaagaacgtgctcgtgaattaaatcgaatccaagctgtgttagaaggctgcaatattaaactgagcagtgtaattaccgatatcagcggaaaaagcggtatggcaattttaaaggcaattgtatctggagaaacagatccggttgttttaagtgaacttgccgaaggaagagccagagataaaattccagaaatgcagaaatccctacaaggacggatatcagaacatcaacaaaaaatgttgaaacatcaactggggcatattgaaagcctgaccgctttaattgtggatttagatgcagatattaaaaaaaaacagaatccataaactgggcaatcgaagctttggatgatatgcctgggattggaagaaaaagtgcagaacgaattttagcggaaactggtgtggaaatggagcactttcaaaatgaatcccgtttcagctcatgggcgggacttgtgcctgagtgtaaggaaagcgccggaaaaaagatgagtacacgaatacggaaaggaaataaatatttgaaagcaacgctggtggaatgtgctcgtgctggaatacgaaacaagcaaagttatctctactcccgttatcaaagaattgccgcgcgcagaggtgggaaaagggctttgattgcagtagcccataccatgttaatcgcgatctatcatatactaaaagagaaagttccttatcatgaccttggagcggattactactccgttatcaatcaagaaaagataatcaataggaatattcgtacattagaaaagttaggggtaaatgtaatgattcagccgaaatgaatctctttaactgtataattaagagaaggaaataagcccgccaaaaggcgagcttatttagaatgcttgtttatagattatcgctgaactacgttttcaggacagccacttttttgtgaattgtagaaattagaaaagattaatgaggacattttgtatatgtataagttgaaatcaaatttcctaatactaaattctggcaggaagaacatctttgcgcttgatattttagaaccttgcaactgccgttggtctttttatcatgtctggtataagttccacttacataggtatgcttacataattttttttctgatatggctacatctggtatggccacattataagaagttccattttcatctgtgaaataagaattagaaaaaagaaaagtatcctcctctttatcaacaactgagaagaagccttccgttccagatatatttttatctttattaagaacttcttctaaggagtgaatattatctatttctacagcgggtgtattataagcaagaatggtaagggaagaagaaatacttaagaatataattccgaatccagttacaatagaagtaaaaatagggtgcttatgtacagtatgttttttcaaatgagtaatcctctctttcagtgtattttttcgatgaaacgtaaatccacttgaagaaacaagtgaaagatgcggtggtgtagatgaatattttaaaaggaccttgccatagtttcttttttgttcgagtgtacaattcattaacgctaaatcatcagcggctaattctgaagtattttgataaaattgaattaaaagataaatacatgggttataccaaaacaaaacagataaaagcataagagttagcttaaataaattatcatggtgttttagatgtgcaagttcatgtttaataatcaaatggtttgtatcatcagacaaattaaaagataaaggtaaaaatagtttcgtgttcaaaaatcctgtcacaaaaggaattgaaatgtggtcggataatgagagaattggagatttagataatctcaaatccctcgataagtttgtaatgatagcttggtttggctgaatgaattctttaaaattaaaatcggaagcaatagttgagcagaaacttttagtttgaagatataatcggcgtatgtaaatagctctaaacagcataatgctaatgcataaaaacagtccgattaaaattccaatactgatattcggtggacgaagaaccagatgattttgaacaattctgattgaatcatcaacaggtattttatctgttggttttggatgcatcataaatggagaaaacaatcgtttgtaataatttgtaagtaaaggaacaggaagtaaaaataagaagatatttactttacaaaataaaagtttatgcttgggcgcaagctgtttattaaataaatgcgttgcgccaatagataaaaataaaaagacacttccgataagattcatataaaaaagtaagcgaatggaagaagcaattattaaatttatcataaaaaaatcacatcctaatctttattgagaaaatctcttagttcatccagctcttcttgtgtacaatcttttttgttgcctgtaagggcagaaagaaacaagttcaaagaaccattaaatgcattgtttaaaaaagattttgcatatctttgagtgagctgttcacgtgtcaattttggaaaataagcttttttacgtccttcatttttacagtctaatgcacccttttcaattagacgtgaaagatgagtgtgtaatgtttgctttttccagtcttttccattgttattaaagaaatccaaaatttgattgaaataaatggggcatttagaagaccatatcatttccatgatttccaattctgtgtcagataaaccgtatcgatttggcataaaaacctccttatgaatgtagtactattttaaaatagtactataaaaatgtggggaggtcaagaagaaataataaacaaataattaataaataattaataaataattaataaaagtattgacgaatactatatttatatagtacaattgtattataaagatataggacgtagcttgagcaatggtgaaaatgtaaagtagagtattatcaaagtaaaaaggaatgtgtagtataaaaatctaatatttactagtaagttttagctaatagaagactttgtctttgtaacagtttattggcataataatattataaattttcagaatattattagagttgctggctttttttaaaaaaatgaaggcttaagagacaaaggcaaactcaggaaagtaatagttcgtgattgaaaaaatgaaaggaatgaaaaaatgaagaagataataaataaagttattgtgttcacattgatttttaatatcagtattattattaatgctatatctattcgagcagcaggtgatgatgataaaaaagtatatacggaattagatgaaaatgtgaggaacatacaagatagtaaagatgcctgtattggtgtggagggcgaaacagagccaaatgaaatgattgagtatagtagagcaactacaaaaccaggtaaatggattaaggcatctgatggacgttggtggtataagcataacgatggaacttatactaaaaatggatgggaatatatagatggaaaatggtactattttgatagtaacggttggatgaagacaggatggattaaagtaaataataagtggtattatttaaatagtagtggagcaatggttgtaggatggcaaaagataggaagtacatggtattattttaattcctcgggagttatgcaaactgggtggaaaaaaataaataatagatggtattttttagaatctaatggagcaatgagaacagcagctttaacacagggcggttcaaactatacatttcagagttcgggagcattaaatacaactaggctgggagttcaaaggcaaaggcaggaacgaactaattggtgctgggcagcttcttgtgttatggtcggaagatatgatttgccggcatcattacaaacaataacacaaacatcagttgttttacatgtaaaaggagaaattattaatcttgcaggaaatggctcagaagaagtgagaggaataaatcatgcttctcaaagtttaaagcatgcaacatctttagaaagaactctctcttttactgaggtacttaatactattgataatagacatccgtttattgtaagaatgagatgggatggtggcggtggtcatgcagttgtatgtgctggttatagatattctgattcttcattataccttatagatccgtgggaaaatacagcgtcgaggtattattcacgtaatagtctggtaagaggtacttctattgctactggtacaggtcaatatagattttcggtaatatattaaaaggatgataagaaagaagggcgtagttatgaaaaaatttttgataatagcagtatttactttctcaattatatttttaaattcctctaatacatacgcttactcaatcgaaacactagacagtaatccagatttacacgaaatttcccaaatggaagacgagatttaccgttgggcgcaaggcgcagtagaagatgaaaatacgaatttacaaatcgattattctcgagcagtgaaaatatatatagatacaaatatttttgaacaagaagaactgacggctgaaaatttacaagatactttagataatgcggtttatatttgggaagttcctgtaaaagtttcagaagacagatatgtgattgtaactgtaagcagggcactgccaattgatgaagaattgcagcaggagcttcttgaagatggcacttatacacaggaagaactggaaatggaacttgaaaaagtaggtagttggacaattccaacagccggatatgatgaaacaaaatcagactatattggaaagttagattctgttttgggagaaactcttaataaagaggatttagatatgatataccttcttggtggaactccgaagatgagacagccttttggtgttgtttgtagagaaggcaaatatcagattgttacattagatgtggtaaccggagaaaatgatataagtgcttttagttcagaagaaagtcaggaactgaatgagaatagtatttatagttttgaacaggtgaaagaagtaatagagtcaatgccagaagtggatgacgaatcagatacagggctagctccaacattaaaaaaagaaaatatgaaaaaagaaaatgctaaaaaggaaaggatatatggtgttgtagttttactggtaacagttttgctggttggcgtagctttgggtaaaaaattgaaacggaaaaaataaatttagagaaagaaggggtgtcgggaaatatctatttcccgacacccctttctttttctaagttagtcaagcggatattcgtattttgattcgctacttccttgattcggttaaattattaattacatcggaagagccatatccccatctttaatccagcctaaatttctcatcatatttgagaagaaataggtcagtgcagccggaagagcaaagtgcataattaaaattttaaataataccactacgcttgaaactcccggaacagccatggtctgccaggtcataatctgtccgacaagtcctgctgttcccattccggaaccggttgcattgtttgtcattttaaagagaagtgtagaaaccggtcctaagatggcactcgataaaatgacaggaagccagatgagtggtttcctcataatattaggaacttgaagcatggaagttccaagcccctgtgcgatcagaccaggagctccattttctttataacttgcaattccaaaaccgaccatgttacaacagcatccgacggttgctgcaccggcggcaagcccggatagatttagaataattccaagggctgcggaactaatcggaagagttaaaatcatacccattaaaacagagacgataacgcccattaagagaggctgttgttcggttccccagttaattaattctcctaattcagtcattaacttgctgattggaggaccaaagaaaagaccgatagccgaaccggttaaaattccggttaaaggggtaataataatgtcaagttgggttttgccggagacaacatgagcaacttcaattgcaatataagcagcaagaaaagcgccaagcggttctccgggaccggaaagtaacagtgcaccatcctccgtgaaaatcgttccggcaaggattttgcttgaataaccgccaaccataccggcagttgcagaagagagtacaaccagaggactttcgccaaatttgcaggcaacaccgatgccgataccggcgctggtcataccggcagctattttaccaaactgatagaggtaagtgccaatttcaccactgattaaagtaccaatctgttgaagaattgttccgataataagagtggcgaacagaccgtaagacataccggtgagtccatcgataaaaaatcggtttaatattttttttaccatgatatctcctgtattctattttacttaatctaatttaatatttttaaaaagagagccgagtgttgtagtagcttcttctgcttccggaagttcatagtcgatgacttcttcctcttcttcttccggagcttctattaaagctttcatgctgagactcagttttccatcttcatttttgataacttttacggttacgttatcgccaacagagaggactgcttttggagatttgattcgtttctggctgatctgtgagatgtgaaccagaccggaaatgccatctccgaggtcaataaatgcaccgtaagtctgaaggctttctacggtaccttctaatacgcttccaacagtaatctgctgtgtttttgcaagtttttcggcgtcagcctgctcttttaataattctcttgcggaaaggacaagacggttttctgcttcatccacttcaaatacacgtaccatcaaagttttctttaaaaattcttccggttctttgacatattccagagaaagtttggaaaccggaataaaggcacggatgccttccacgtaagcgattgctccgccttttacgatgccttcaatagtaacttcaaatgcttctttatcttctttcatctgttctaacttgtcccagatttccatgtctgcgtcacggaaattgctgaaagaagcttcgatttcctgtgcaaaatcatccattgtttcctgtttttttatttcttcgctcatgatgctacctccattaatacttccttaaataaaattgaaaaataggaagctttttgttttcgattatagcacaggaaagtgaaaatctgcaatggagtagagagaatgttgaaagatttgttgattttgtcgggtgggttaaggtaagataagaaagactaaaaaccgatgtagatagttctgacaaaaagccagaatagaaagagagaaagaccgatggaaatcagaaaagcaaaaatagaagaactcgatgaaattatggaaatttttgaacatgcacgtcagtttatggcgaagaacggaaatgcgtcccagtggggaacaacttatccggaacaggaaatcgtagaagcagatatcaaaaaagaagagtgttatgtgtgtgtcgaaaatggtgaaatcgaggcaacgtttgtattttttatgggaaaagtagaaccaaattatgtggatatttatgacggagagtggaaaaatgaagctccttatggtacaatccaccgcgtagcaagtcgcggaagagttccgggaatctcaaaaatctgtatggatttctgcaaatcacagatttcgaatctgcgtggagatacttataaggataatattgtaatgcagaaagtatttgccaaaaatggatttgaaaaatgcggtacgatttatcttgctggaaaaaaagaagatggaaacgcacgaattgcctatcagtttgtgggtaaataattgcacgcagaagaaaaatgggatattatatagagtagaagaaaaatttgaaatagaaaagaatttggaatgtaaatataagaaagggaagcacacaacatggcgaaacaagaaaaaatctatattttaggacataaaaatccagataccgattcgatttgttcagcgattgcttatgcagatattaaaaatcgttcgaatgatggaagaaagtatattgcaaaacgtgcaggtcagataaatgaagaaacagagtatgttttaaaacgttttggcgttgatgcaccaggctatcttccggatgtcggaactcaggtaagagatatggaaattagggaaactccgggagttccgcacagcatttccattaaggatgcatgggcgattatgaaagaaaccaatgcggtgacacttcctattacaaaagaggacggacagttagagggactgattacaaccggagatattgcaaaatcttatatggatgcgcatgataattatttcctttccaatgcgagaacccagtatcgaagtattgcgaatacagtagaaggaaagattgtaaccggaaacggacatggatatttcttaagaggaaaagttgtaatcggtgcgacacttccggaaaaactgggagagtacttagaagaagatgatttggttatcttaggagatagatacgaagaccatttatgtgcgattgaagaaaatgtaagctgtattattgtgtgtaacaatgcggaagttgcagaggatattcaggaagcagcaacgaaaaatgactgtgtaattatccgttctccgcttgatacctttacgattgcgcgtctgattaatcagagtattccggtcaaacacatcatgaaaaaagataatctgattaccttccagaccgatgattttacagaccagattaaagaggtgatggtaaagaaccgtcacagagccttccctgtagtaaataaacatggaaaatatattggaacggtttccagacgaaatttgctgggaatgaagaaaaaagaagtgattttagtagaccataatgaacgttcccaggcagttgataatattgaggcagcggagattctggaaattattgaccatcacagaatcggctctatcgaaaccatgtctccgattgtctttcgtaatcagccggtgggctgtactgcgacgattatgcatcagatgtatgtggaacgaaatctcgaagtttctccggcaatcgcaggacttttatgcgcagcgattatttccgatacgctgatgtttcgttcgccgacctgtacacacagagataagatggcagcaggagcacttgctttagtagccggtattaacatagaagaatttgccaaagaaatgtttacggcaggaagcaatttaaagggaaagacaacagagggaatcttctatcaggatttcaaacgttttacaaccgaacaggtaaactttggcgtaggacaaatcagttctatgaatcaggatgaactgttaagcttaaagaaacgtctgattccatttatgaaaaaagaatgtggaaaaaatggaattacgatggtatttattatgcttacgaatattttggaggaaacatcagaaattatctgttatggagatggaagtggcagattggttgaggatgcctttaatgtaaaagaagaaaatggcggatatattcttccgggagtcgtatcaagaaagaagcagttaattccggaatttatcactgccttacagcagaatagctaaaagagaaaatctcgaagaaatgaaaaacagaagaaggggaaacacatgggaaaaattgaatggaagcctggaaacatgctttatcctctgccggttgtaatggtcacggtggcagatgaagcagggaatgataacattatcacggtagcatgggcgggaacggtctgcaccaaccctcctatggtatcaatttcggtaagaccggagcggtattcttatacaatgctatgtgacacaaaggaatttgtcatcaatctgacaaccgaaaaactggttcgcgcaacggactattgtggtgtaaaatcaggaagagaggtagataaatttaaagaaacaggactcaccagagaaaaagcatctcatgtgggtgttccgatgattaaggaatctccggtctgcattgaatgcagggtcagggaaatcaaagaactgggaagccacagcacatttgttgccgatgtgcttgcagtccatgtagatgataaatatatggatgaaaaaggaaaatttgatttagcacttgccaatccgattgtatattctcatggggaatattatggactgggcaaaaaactgggaacttttggatacagcataagaaaacagagaaagaagagacagaagaaatgagtaaagaaaatatcgttttaattggcatgcctggagttggcaaaagtacagtaggtgttattttggcaaaagtattgggatatcagtttattgatgcggatttagtaattcagaaaagagaaaaccgcctgttgcatgaaattatttcagaagaaggtttggatggctttttaaaagcagaagaaaatgcaaatgtatacattgcgcaaaatgaagaaaaatcgattgttgcgacaggtggaagtgttgtgtattgtgaaaaagcgatgcaggagttgaaaaaaacaggacgagttatatacttggagttggaatatgaccagctgaaaaagagactgggaaatttaaaaggtcgtggtgtggtattaaaagatggtcaggatttaagagggttatatgaagaaagaattccgctgtatgagaaatatgcggatttgacagttaatgaaaaaaatctggatgtagaacagactttacagaaaatagttgacagactttcattataactgacaaaatgaggaattgcaagcagtaaatctaggcaaaagacgattttttgtttacaaacccggtaagatgttataagataagggttgactattatgaaactttgaaaatcaggttatgaatttgatgataagaatgacaaaaacaggcatcagatacatgaataaaaatatagaggtgtgtatatggaacaatatgtaatcaaaggcggtaacccgctcgttggtgaagttgaaatcggtggagcaaaaaatgcagcacttgcgattctggcagcggcaattatgacagatgaaatggtttatattgaaaaccttccggatgtaagagatatcaatgtattactcgaagcaattaaagaaatcggagcagttgtagaaagagtcagtccgacagaagtaaaaatcacaggttctactatttctgatatcagtgttgagtatgaatacatcaagaaaatcagagcatcttattacttattaggagcactgctcggaaaatataaatccgcagaagttccacttccgggcggatgtaatatcggaagtcgtccgattgaccagcatttaaaaggattccgtgcactgggtgcatccgtagatattcttcacggtgcagtcgttgcaaaagcagagaacttgacaggaaaacatattttcctggatatggtatctgtaggtgctacaatcaatatcatgatggcagctgcaatggcaaccggaaataccattattgaaaatgcagcaagagagccgcatgttgtcgatgtggcaaacttcttaaacagcatgggagcaagtatcaagggtgcaggtaccgatgtaatccgtattcagggtgtagaaaagttacatggaacaacttattccattattccggatcagattgaagccggaacatttatgtgcgcagccgcagcgaccagaggcgatattatggtaaaaaatgtaattccgaaacatctggaagcaacaactgcaaaattagaagaaatcggatgtcaggtagaagaatttgatgatgcggtgcgtgtagtggcaaacaaacgtctgactcgtactcatgtaaagactatgccatatccgggttatccaaccgatatgcagcctcagtttgcagtcgcacttactttggcagaaggaacaagtattgtaacagaatctatctttgaaaatcgttttaaatatgcggacgagctttctcgtatgggtgccaatatcaaagtagaaggaaatacagcaatcattgatggcgtggaaaaactgacaggcgcaagagtcagcgcaccagaccttcgtgcaggtgcagcacttgtaattgccggtcttgcggcagaaggattcacagtcgtagatgatattgtttatatccagagaggatatgagcgatttgaagataaattaagaagccttggtgctgagattgaacgagtatccagtgaaaaggaaattcagaaatttcagcttagaatcggctgaaaaccagtaaaatagcattaaaaataaaaaaaacggtttggaataaaatccaaatcgttttttccttgacaatgtttagcacctgtgctatggtaagtgcgtgtatagatttcatatcaacttattaagtgcatcacagacattttcccctctttttttgtccgtggtgaaaagggaatcaggtgaaaatcctgagcggtccggccactgtaagcaaggagcgaagcgcaagaatccattgtattagagcgtacgagaaggagcgccaagcgttgataggcaagtcaggaaacctgcttaagtaagtgaaaggttgaaacttccgaagaaagttttccatccatgatatctgatatggaacgccttatgcttgaaaaagcacgtatcagaagaacggtacattctgatacaaacttagaggaacctgtgtacggaatttatacatcctttactttgaaagggcaggagaattccaaaagctgtattcgtacataaaacctccgcaaaaaatatgtatgattggtcaatacaggtggaggaattcctcctgcaaaaagttaaaatggacaataaaaacaaagctgttatagataatagtatcttatctgtaacggctttttttggtataatagaaaaagttagtaaaggtatttgaaaggggaaatttaagatgaaaaaaatagaaatggaaaaacaggcaaaagcatttggatttgcaacaatgaaatttatggaaacaaaagatctggagtttgaacatgaatttcgacagttttgtgagatgaatgactgtgggaattatggaaataattatgcctgtccaccgctttgcggaacaccggaggaaatggagcaaaaggtaagaaaatacgaacatgcgttggtttttcagtcaagaactccggttcaaaatatttttgatgatgcagaaacaaaaattattaagaagatgcatacaaataaaacattacatgccgtagaagaattgaaagagcagggtctgcctgataatggaatgtttattatgtgcggaccatgtaatttctgtgaggaatgtaaagcaaaagcaaaagaaccatgtgtcaatgaaacgatgcgtttttcgtgtctttctgcttactgcattgatgcaggaaagatggcaaagcattgtaatatgaatatggaatggaacggagatgtggtttcgttttttagtctatatgttttttaagagaataggacagggtgtatgagacaagagcttaatttaacgcagacgcagaaactatcagaaaagatgattcagtcacatccgctcagtgaccagaaaattgcagagaagatgcaggaaaaaggaatcagcatttcaagaagaacggttgcgaaatatcggggtcagatgggaatcgcagatgccggaggtagaaaagtgtatttgtaagaaaatataaggagatattttagtaaaaataaggaaaatcggaaaaataccttgcttttttaaaaataacgtgtataatacaccatgaaactataaaaaaatcaaatagtggttatcccttttattcagagtgatggaggtacataggacctgtgaagtcacggcaaccccttgaaaaaggaaggtgccagcctgagcgagtaagtcgaacaataagaggattcatttaaaaacttatgggtccgcttgtctgcggacctttttacttgcatgtaaatgggaataagaaacaaaaaatcaaacaaaggagaacaagaagaatggaaaaaagattatttacttccgagtccgtaacagaaggacatccagacaagatgtgtgatgcgatttccgatgcaattctggatgcattaatggaacaagacccaatgagccgtgttgcatgcgaaacatgcacaacaaccggtgttgttatggttatgggtgaaattacaacaaaagcttatgtagatattccgaaaatcgtaagagaaacggttcgtgaaatcggatatacaagagcaaaatatggttttgatgcagatacctgcggtgttatcacaacaattgatgagcagtctgctgatattgcgatgggtgttgataaagcgctggaagcaaaagaaaacaccatgtctgatgaagaaatcgatgcaatcggtgctggtgaccagggtatgatgttcggttttgcaagtgatgaaacagaagaatatatgccatatccaattgctctggctcacaaactgtctcgtcagcttacaaaagttcgtaaagatggaactttaacttatttaagaccggatggaaaaacacaggttactgtagaatatgatgaaaatgacaagccaatgcgtctcgatgcggttgtattatctacacagcatgacccggaagtaacacaggaacagattcatgaagatatcaaaaaatatgtatttgacccgattcttccggcagaaatggtagatgaaaatacaaaattcttcatcaacccgacaggacgtttcgtaatcggtggacctcacggagacagtggtttgacaggacgtaagattatcgtagatacttacggtggatatgctcgtcacggcggtggagctttctccggaaaagactgtacaaaagtagaccgttctgcagcttatgcagcacgttacgttgcaaaaaatatggtagcagcaggtcttgcaaagaaatgtgaaattcagctttcttatgcgatcggtgttgcacatccaacttctatccaggttgacacttttggaacaggaaaactttccgaccagagactgacagaaatcgttcgtgaaaacttcgacttaagaccggcaggaattatcaaaatgcttaacttacgtcgtccgatttacaaacagacagccgcttacggacatttcggaagaaatgacttaaatctgccatgggaagcactggataaagtagaagaactgaaaaaatatctggaagattaataaaagaaatttctaagattcactaaaaaaagtggagaatagataagaataacagggagttttttgtagaaatatgaaaaatttcctgtttttttgtgatataatatgatgtaagtgtcaaaagtataaattgcggttgtgcttgcacaaaaagcaatttatagaaagtttagacttgttttattaatattttcaagaaagagaagaggtttatgttataattatcgttataaaaattttatcttaagttttggaatgggataaacactaaaaaaacaggcaggaaaggagaaaaaggagcaatgaaacttaaaacaagaatcgttatctccttttttgttattatcctcgaaccgctaatctgcgcaagtgttgcattttgggcattcagccagcatcagttaaatgtgatggaagaacaatatggaattgaaaatgcctcttatgattcactttctaatacggcagaagtgattaacagcatgaccgatgacattgcagaagagctgagggagacggcaaaaaaagatacgaaagaattagagaatgaagattatttaaatcgaatcaatggcagattaaaggaagtacattcctatctcttagtaagagaaggaaaccaaattatctattatggaaatgaaaattattcaagtgaacttgtgaaacggctgcctccttatgcctcaattgaagatgagaactccgaagaagccattgatgcacaggataatgatggactttatctgggaggaacagtacaggcactggtgaaacagattaattttgaaaaaccagatggaacacagggcagtgtctttattgtgtcaagtattttaaaaactctgccgcagttaaaggcactgataaaaaatatgatgatttctgtagtggtgattttgattcttaccggtcttggactgacctggtggatttaccgtggagtcattgcaccgcttgataaactgcgtacagcgacacagaagattaaagatggagaccttgatttttcgattacaccggaaggtgtgagtgaaatttcggacttgtgtcaggattttgaagaaatgcgtcagcgtttaaaagagacatccgaagagaaagttcagttcgataaagaaagcaaagagttaatcagcaacatttcccatgatctgaagacgccgattacagcaattaaaggctatgtggagggaatcatggatggtgttgccaatacaccggaaaaaatggataaatatatccatacgatttataataaggcaaacgatatggatcgtctgattaatcagcttacattttatacaaagatggacactaaccgaattccatatacatttaacaagatttccgtaaccgaattttttaatgactgtgcagaagaaattggaatggaacttgaatcaaaaggggtagagtttaactattcaaactatgtaggaccagaggtgctagttattgcggatgcagaacagattaagcgagtgattaataatattaccagcaattctttgaaatatatggacagcaccagagcacgccgaattaatttaagagtaaaagatgtcggagattttattcaggtagaaatcgaagataacggaaaaggaatctcagcaaaagatttaccaaatatctttgaacggttctaccgaacagatgcgtcaagaaattcttctaaaggcggaagtggaatcggtctttcaattgtaaagaaaattatggaggatcatggaggaaaagtctgggcaaccagcaaggaaaatattggtacagtcatgtactttgttttaagaaaataccaggaggtttatcagtaaatgagtaaaattttaattattgaagatgaagaggcaattgctgatttagagaaggattatctggagttgagcggatttgaagtggaaatcgaaaaccgcggagatgtcggattaaaaaaggcattagagggagagtatgatttatttatccttgatttaatgcttccggaagtagatggatttgaaatctgccgtgaaatccgaaatgtgaaaaacacaccgattatcatggtttctgcaaagaaagatgatattgataaaatccgtggtcttggacttggtgcagatgattatatgacaaaaccgtttagcccgagtgagctggttgcaagggtaaaagcccatctggctcgttatgaacgcctgattggaaccggggtacaggaaaatgatatcatcgagatccgcggcttaaagattgataagacagcaagacgtgtctggattaatggagaagagaagaattttacaaccaaagaatttgatttattaaccttccttgcacagaatccaaaccgtgtctttacaaaagacgaactctttaaagaaatctgggcgatggaatccattggtgatattgcgacagtaaccgtacacattaaaaagattcgtgaaaagattgaattaaatacagcaaaaccacagtatattgagacaatctggggtgttggatatcgtttcaaagtctgaaaaaatatacttgacaaatacgcaagaatatcgtacagtaaagtggtaaaaacaaggggagcttatttgataggctgagaggaagttaagaacttcgacccataacctgatttggataatgccaacgtagggacagacgtatgaaatgttgcgggagatgtcagaagttggcacctcccgttttttatgtatcctcataatcaagcacagaaagattctgagtgtacgatgtttttaattatttgacaattgaataagtaataccaagtgattgaatgagagttcatgaaggggtgcaccaccgcgggtgtatttctttcgtgaactcttttttatttcattaaaaagttttgtcatgaaaaataaaaaacatgttctacaaaatgccaaacaggaaaattaagaaagtacatcaagaaagtgaggagtttagaatgattaaagtaaatggaagagagcgagattttgttccgaataccaccattgcacagctcttagagcagatgggttacaacctgactcgtgtagcggtagagtgtaatggaaagattgttccaaagaagcatttagctgaaacattaacaacagatggagacgtcttagaagttgtaagttttgtaggaggaggctgagatgttaacaaaagaagaaatcagggaggcgcttgttgagcgtcattcggaggaagttcaaagtaaattagatgaggcaaaagtggcgattgcaggacttggcggacttggctcaaatattgcattttttcttaccagaatcggtatcggacatctgcatctgattgattttgatagagtagatattacgaatttaaaccgtcagcagtatcgcatggaacatattggcagatacaagacggaagcacttttggaggaacttcgggaaatcaatccataccttgaggtagagacagactgtgtgagagtgacggatgaaaatgtagggactttatttcacaatgaagacattatctgcgaagcattcgaccgtccggaagcaaaagcaatgttagtcagcggagtaggagaatattatccggataagattttagtcaccggatccggcatggcaggctatggaagaagcaacgagattgtgacaagaaaaatcaatgagcatttttatttatgtggggatgcgcataccgaaccggtaaagggaagagggcttatggcaccgagagttgcaatctgtgcagcacatcaggcaaatctgattacagaactgattatcagaggcaaatagagaagagaaaaagaaagttaaaaagaaaataaaataagaaaaaataggatatagaaaaccagatggaggaaaacaaaatgaataatgatacatttacacttgggggacatacatttgagtctcgttttattttaggttcaggaaaatattctctggatttaattaaagcagcagtggaaaaagcaggagcacagattattacattggcactgagacgtgcaaatgagggaggaatggcaaatatcttagactacattcctgaaaatgtcacactgcttccaaatacatcgggtgcaagaaatgcagaagaagcagtgcgtattgcaagactttccagagaactcggatgtggagattttgtaaaaatcgaagtcatccatgattccaaatatctgtttccggataactatgaaaccatcaaggcaacggaaattctggcaaaagagggatttgtcgttatgccatatatgtatccggatttaaatgtggcaagagaacttcgggatgccggtgcagcgtgtgtaatgcctcttggttctccgattggttcaaataaaggaatttgcacaaaagaatttattcagattttaattgatgaaattgatttaccgattattgtagatgcaggaatcggtaaaccatctcaggcatgtgaggcaatggaaatgggggcagcagcagttatggcaaatactgcaattgcaacagcaggtgacattccggcgatggcagaggcatttaagcaagcaattgaagcaggaagagccgcttatctggcaggtatgggacgtgtcatggaaaaaggagcaagtgcatcttctccgcttaccggatttttacaggattaagagcggggggagaaaaaagatgagtacagaaaaccatgtaaatgagagtattttaaatgatgaaattaaagagtggcagaagaaaaaccgtatcgaccacatgacttatttaaaaggaatggaagtgcttgagtccgatgtgcagaaacaggtcattgatgccatgaatgagtatgactatgagaaatataccgcaaaggatgtagaacgtgcccttgcgcatgagagccgtactccggaagattttgcggcactgttatcaccggcagcactgccgtatttagagcagatggcacaggctgcaaaggcagaaaaagaaaaacactttggaaatggtgtcaatatgtttacaccgatttatattgcaaattactgtgaaaatttttgtatttattgtggatttaactgccataataaaattaaccgcgcaaaattaaatgcacaggaaatcgagaaagagatggcagcagttgccaaaacaggacttcaggaagttttgattttgactggagaaagtcgaaaatattcggatgtgaaatacataggagaagcctgtaaaatcgcaagaaaatattttaaagtaatcggtcttgaggtttatccgatgaattctgatgagtatgcttatctgcatgaatgtggcgcagactatgtaaccgtattccaggaatcctataattcggataagtacgaaacgctgcatcttgcaggtcataaacgaattttcccataccgcttaaatgcgcaggaacgtgccttaaaaggtggaatgagaggtgttggattcgccgctttgcttggtctggatgatttcagaaaagatgcgtttgcaacaggtatgcatgcatatctgctccagagaaaatatccacacgcagaaattgcattttcctgtccgagactgcgtccgattatcaataatgacaagattaatccgatggatgtccatgaaccacagctgcttcaggtagtatgtgcttaccgcctgtttatgccattttcgagtattacggtatcaaccagagagtgctcccgtgtgagggataatctggtcaatattgcagcaacaaagatttcagcaggagtcagcacgggaatcggagaacacgtagaagagattgagaataaaggagatgaccagtttgaaatctcggatggaagaagtgtggaagaagtctatgaggcacttcttgatgaaggacttcagccggttatgaatgactatgtttatgtataaagaacaggtaatagcagttacgaatcgaaaactctgtcgagacagagaagcgtttttatggcagataaaaagaatctgcaagaatcagcctcatgctgtgattctgcgtgaaaaagacctttcagaaagtgaatatacagcacttttgttttcggtaaaaaagatttgcgaggagcataaggtaagttgtattgcacatacttatacggaatcggcacttgaagtcggatgcacgaaaattcatgttccgcttgctgttttagaagcaaaccctgagattgcacagaagtttgaagtgacgggagtttctacacacagcaaagaagatgcaaaaaaagcgcaaaagctgggtgcttcttatgtgacagccggacatatatttgcgacaacctgtaaaccgggacttgaaccgagaggaacggcatttttaaaagaagtgtgcgatgaggtggaaatcccggtgtttgcaatcgggggcatgaaaacaacgagggaatgtgtggaggaaatgcgaaaactgggcgcttcaggaatttgtgtcatgtctgagtgtatgaaatggatctgactgcgtaaaagaaatttcagcttgcaagaacgtacaaaatatgctaagattccatcgaaagcagtattatttgaaataagaaaagcgatgaagagaaatagtagatattagtcctatgtacagagagaagccggttggtggaaggctttgataagatggtatcgaaccggtcttggagctgcaggttgaaattgagccggaaatttatcaggcataagaaagtagacactgtcggaagtcccccgttaaaaggaaatgatatcgaggaaactctgtatctatgagtgtgggagtaatcctgaattcaggtggtaacacggatgaatattcgccctgaactgattgaagaaatttgtcagttcagggttttttatttcattaattaatttcattttttgttgagtttaaagattttttaggaggaagtaaatatgaagttaagtaaacttgtaggagacagatttaaagaaagaccgtctgactgtgttatcgacagtcatgcactgatggtaagaggtggttacatgaagtatgtggcaaacggaatttattcccagtatatgccgcttcgtcgtgtatgccagaaaattgaagcaattatccgtgacgagatggataaaatcgatggacaggaagtacagtttccggttgccctgccggcatctttatgggaagaatccggaagatatgaaagcgttggaagtgaactgcttcgtttcaaagacagaaacggaagcaaaatggtacttggtatgacccatgaagaggcagcggttcagttagtaagagaatatggacagacttacgcaaaatatccatttatgatttatcagttccagacaaaattccgtgatgaagcacgtccaagagccggtctgatccgtgtacgtgaatttactatgaaagatgcgtattctttccacacatctcaggaagatttggaagaatattatgacaaatgttatcatgcttatgaaagaatttttgcaagagccggaattccggaaacaatcgcagttgcatctgactctggtatgatgggtggaagcctttctcatgaatttatgcttttgactccggttggagaagattccattgcagtatgcccggaatgtggttacaaagcaaatgtagaggcagcagaaaacattgtagaaaatgaagctgaagaatatcaggaattaaaactggtgagcactccaaatatgcatacaatcgaagaagtatgtgaattcttaaacagctcagcagaaaaatcctgtaaagcggtagtatatcagaaaaattccaatgatgaatacgttgtattatttatcagaggggacttggaagcaaatgaaacaaaactgacaaacttcttaaaagaagaaattcatccggcagaaattaccttagaaagtggattacatccaggatttatcggaccttacaagatggatgcaaatgtaactgttttatatgacagttctttaaaaggtggatgcaatctttgctgtggcggaaatcaggatgattatcattacacagggctttgtatggaaagagatcttccggatgcagaatatcatgattttgcaaaaatcgtagatggcggaatctgcccatgttgtaagaaaaaagcaatcaaagtatcaagaggtatcgaagtcggaaacattttccagctcggaacaaaatatacgaagagcatgggaatgaaatatctcgataaagacagcaaagaaaaatatccgattatgggatgttatggaattggtgtcggcagacttgctgcatctgtctgcgaagcacatcatgatgagtatggtccaatctggccaatgacaattgctccatggcaggttcacctttgctgtgtacgtccggacaatgaagaaatcaagaactattcagatggtttatatgaacagttacagaacgcaggaatcgaagtactttacgatgacagaaaagtaagtgccggtgttatgttcagcgatgctgacttaatgggtattccggttcgtatcattgcaagcccaagaaatatgaaagagggatgctgtgaagtggtaacaagagataaatctgtaagagaaaaagtagcattagaggatgtatttgcaactgttcagaaaatggtacaggaagcacttgcaagataagttaaccgaatgaaagagtgaagtggattgtgaatatccaccggacaaatataagaaattaaaaaaatgaaaaaatatatcgatgaagcattatatgaatacagcaaaggagaggtttatccatttcacatgccggggcataagcgcagcttctgccctgagacattaaaaaatccttatgaaattgatattaccgagattaccggatttgataatctgcatcatgcggagggaattctcttagaagcacagaaacgtgttgcaaagttgtaccatgcagataaaagcttttatctgataaatggaagtaccgccgggcttttaagtgcaatttcagcatgtaccagtgatgggggcagtattttgatggcaagaaactgtcataaagctgcctatcatgcagtttatttaagacgtctgcatgcacattatttatatccggctgtgtttgaagagacagaattaaatggcggaattacaccgaaagcggtagaagaagctttgaacgtctgtcctgagatagaagcagtactgattacttcgccatcttatgacggaatggtgtctgatattgctgaaattagtgagattgtacacgcacatcaaattccactgattgtagatgaggcacatggagctcatcttcgtttttcagatacatttccagagtctgcacttgaaaacggcgcagatatcgtaatccagagtctgcataaaactttgccttcattgacacaaactgccctgctgcacacgcagggcagtcttgtatctgaagaacggttgaagcggtttctttcaatttatcagagcagtagcccgtcttatgtttttatgagcagtatggatgcctgtatccgactgctggagtcttcttcggaagtgttatttaaagaatacacggtacgattaaaggagtgtcgcagaaagctttctgatttgaagcatctgcatctggtcaaaccggatgaagtagtcgggaaaaatggcgtctatgatatggattgttctaaaattattatttcaacaaaggggacttctattgatggagagatgcttcggaaaaaactgcttgataaatatcagttagaaatggaaatgaccgctccgtcttatgtgctggcactttcaagcgtgatggacagtgaagaaggatttgcacggcttgcaggtgcacttttggaaattgattcggcatttgattctgagatgaaaaatcaaataaaggagaaagcgcagacaaaaattgagtttacagataaagatgcaatatgtaccattgcagaggcgatggatgcagactgggaagaagtgaatttaaaagaagcagaggaaagagtgagtacagagtttgcgtatctttatccaccggggattccgtgtattgtgccgggagaaagggtaacaaaagagctgattgaaaaaatagagagctggaaaatgcaggggcttgaagtacagggattgattgattatcatgcacagaagattcgtgtgcaaaaaaggtgaattatgggaaaaatattttatatcatgggaaaaagttcttccggaaaagacaccatctaccgaaagcttcaggaatcagagaatttaaagcttggaagactggtgctttatactactcgtccgattcgtgacggagaaaaagaaggacaggaataccactttgtagatgaggcaaagtattttgaatttgataaagcagaaaaagtgattgaagcaagaacctatcagacagtttacggaccgtggacttattttacagcagatgacggctcggttgatttaagcaaaaccagttatcttgccattggaacgcttgaatcctatcagaatctgaaagcatattatggagtagcgtcgctgtgtccgatttatgtggaggtggaagatggggagcgtctaaaacgtgccattgcaagagaggaaacccagaaagaaccacattatgaggaactttgtcgtcgttttcttgccgatgcggaggatttctcggaagaaaaattagagcaggcaggaattgaaaaacgattttttaataaaagtttagagacgtgtctgagtgaaataacagcatatatcaaaaaacgcttaatagaatcttaatagaaatgttagagaaggaattattgagtgcatttcaatcgtgtggtataatgagaacatattcgaaatggtatcatgttatggtatcacgttatcattttgagacatacaagacattattaggacaaggtgggtgattgcaatgcaggaagttgaaaaagtattgggacacgaagaggtaatccgtcatttgcagaatgcagttgagaaggaacaggtttcacattcttatatttttgcaggagaaaaaggaagcggtaaaaaacttctggcaaaattatttgccatgacattgcaatgcgaggaacataaaaaagagccgtgtatgcattgcagttcctgtagaaaagcaatgagccggaatcatccggacattatctatgtggagcatgtaaagccgacttcgattggtatcgaagaaatccgcgaacaactggtttcggatgtggaaatcaaaccgtataccggtccttataaaatttatatcgtagatgaagcggagaagatgacgatacaggctcaaaatgccctgttaaagacaattgaagaaccgccggcttatgctgtgattctgcttttggcaaacaataataccggacttttgccgacgattacttcaagatgtgtgacactgaattttaaaccggtgcgcgatgaagtcattcgtaagtatctgatggaagaactgcatgtaccggattatcaggcagatgtcagtgtggcatttgcacagggaaatgtaggaaaagcaaaacagattgcaactgcagaagattttacagaaatgatggatgcggctttccgtatcttacgtcgtggaagcgatatggaagtttatgaaatggtagatgcactgaaaaacctttctgaacagaaacatacgatttatgagtatctggatttgtttttagtatggtttcgagatgtgttgttatttaaggccaccaaagaaatggacagtctggtttttaaagatgaatacaattttatcaaagagagagcagataagagttcctatgaggggcttgagaccattatcaaggcgattgagactgcaaaagcgcgtttgcaggcgaatgttaattttgacttaacaatggaactattgttcctgacaatcagggagaactaataaatgacaagagtaataggagtcagattccgtaacgtgggaaagatttattatttttcaccgaaggattttgatatttgtgttggagaccacgtaattgtggagacagcgagaggagtggaatacgggcatgtcgtgcttgctccgagagatgtggaagatgaaaaggtggtacagcctttaaaagaagtaatcagaattgcgactccacaggatgacaaaaaagaagaggcaaaccggaagcgtgaaaaagaggcgtatcagatttgtttaaagaaaatcagagagcacggactcgagatgaaactaattgatgtcgagtatacctttgataataataaagtattattttattttaccgctgatggaagaattgatttccgtgagttggtaaaagatttggcagctatctttaagacaagaattgaactgcgccagattggtgtgcgtgatgagacaaaaatcttaggtggaatcggaatctgtggacgtccgctgtgctgtcacacttatctttctgagtttgcaccggtatccattaagatggcaaaggaacagaatctgtcgttgaatccgtcgaaaatttccggtgtatgtggacgactgatgtgctgtctgaaaaatgaggaagaaacttacgaagaattaaatcgcaaacttcctggaatcggtgacagagtgaccaccgcagatggtttaagaggagaggtgcacagtgtcagcgtgttaagacagctggtaaaagttattgttgatgtggatggcgaaaaagaaattcgggaatatccggtggaagacttaaaattcagaccgcgtcagaaaaaagaaaaattccgcctcagcgatgaggaaatgagagctttaaaagaactggagaagaaataaatgaaagacaagaatgaacgtcttgatgaccttcaaaatggctatatgctctttcagaatccgaaacagttctgttttgggatagacgctgtccttcttgcctggtttgcaaaagccaagccgggtgagagggtacttgatatggggacgggcacaggaatcgtccctattttaatgaaagcaagatatccgaaaggatattttacaggactggaaatccaagaagaaagtgcagatctggcaagaagaagtgtcgcatataataaactggaacaggatattgatatcgtaaccggagatatcaaagaagcaggtgcagtgtttggcggcgcttcttttgatgtcgtaacgacaaaccctccgtacatgattggaagtcatggactaaccggagaaaacagtgcaaagacgattgcaaggcatgaaacgttgtgtacactggatgatatcatagctcaggcagcgaaggtgcttgtgccaaagggaagattttatatggtgcaccggccgtttcgtctggctgaaattatgtcggttatggtaaaatataaaattgagccaaagaggatgcgtctggtacagccttatgcagacaaagagccaaatctggtcttaattgaaggactgcgtggaggaaaatcacggattgaagtggaacgcccattgattgtgtatgaaaaaacgggtgtttataccgatgaaattcttgatatctacggaagaaatcatgaggaaaaattatgagtggaaaattatatttgtgcgcaactccgataggtaatctggaagatatgacgtttcgtgtggtgcgcacattaaaagaagtggatttaattgcggcggaagacaccagaaacagcattaagcttttaaaccattttgaaatcaaaacaccaatgaccagttatcatgaatacaacaagattgataaagggcattatctggtagaacagttattagaaggaaaaaatattgcgttggttacggatgccggaacgcctgggatttccgacccgggagaagaactggttgcgatgtgttatgaggcaggaattgaagtgacatcccttccgggaccggcagcctgcattacagctttgactttatccggactttctacacggcgctttgcgtttgaagcgtttttaccgtcggataaaaaagaaaaaaagaaaatattagaagagttaaaaacagagactcgaaccatgataatgtatgaagcaccacatcgtctgcttcgtaccttagaagaattatttgaaacccttggagatagaaggcttaccgtgtgtcgggaactgacaaagaaacatgagacggcatttgtgacaaccatttcagaagcccttaagtggtatggaaaacatgaaccaaaaggggagtgtgtacttgtaatcgaaggaaagaaccgaaaagaaatggaagaagaagcccagaaaaaatgggaagagatgccgttagaggaacatttggaacattatatgcaacagggaaacgacaaaaaagaagcaatgaaaaaggtggcaaaagacagaggaatcagcaaacgtgatgtatatcaggcactgctgaaaaaggaataaaaatgaagcagatggataaaaaagacttaagcaaaaaggcaaaaatatggttcgaaaaggcaaaagaatggcttaaaagagcaaaagaagccttaaagaaactggaattaaagaaaaaatatgagttgtttaaggaaaagctgccggaggataaaaaagcaagaacgattattctggcagatattgtattagtggttttattgatttttacactgcttctggtaggatgtaaaaacctgttgaccggaggaaagaagcaaaaagaagagacagccatttcagaagaaatggaaaaaacaacaaaacgaaaaaataaaacggtaagttttaccattagtgcagtgggagactgtacatttggaacggatgaaaattttgcttatgagggcagtatgccggcaaaatatgatgaggttggagattttaattatttctttgaaaatgtaaaatctgtttttgaagcagatgatttaacaattgtaaactttgagggtacgctgacagacagtacaacccgtgaggataaacaatttgcgtttaaagcagataaaagctatgcggaaattttaacagatggctttgtagaggctgccaatcttgcgaataatcacagtaaagattatggtgaacagagctataacgatacgatggatgcacttgatgaagccggaattacaaactttggttatgacagggtagcaatcaagaaagtaaaaggcatcaaggttggtctggttggtacttacgtgttggcagatggtctgggcgtgaaagattccatggagaaaaatattcaggatttgaaggatgagggcgcacaggttatcattgcgagttttcattggggagaggaaaaagcagagtatccaaatgatgtgcaggtagaacttgcgcatgctgcaattgatgcaggagcagacttggtgcttggacatcatccacatgtacttcagggaattgaacagtataaaggaaaaaatattgtatacagtcttggcaatttctgcttcggtggaaatatgtatccatctgatatggataccatgattttccagcagacttttactctaaaaggtggaaaactgcaggaagataatgtgacaaatatcattccatgcagtatttcttcggtagaggactataataattatcagccgacaccggcagcgggagagaaagaaacggaaatcttaaataagataacccaaagaagtcagggactttctaatgaaaatacagaagaatctgattcggaaaatgataatagcgattctgatgaaagctatgatgattcggaagatgataatagcggttctgatgagtatgatgattctgacgagtaatattccgattccttcttgtatagaataaaaagaagagtcaaaacaggataaaagtatgctgaatcttttatggggagctatgatgctcatcggcattctgtatggcgcagtgacaggaaggcttgcggaagtaacggatgcagcgttgtcctgtgctaaagaagcggttgcactttgtattacgatgtccggaattgtagcgatgtggatgggaatcatgcagattgcgagaagttcggggttaatcgataagatgacagagaaaatgcagccgcttttgcattttttatttcctaaaataccaaaagaacatccggcaatggaatatatttccgctaatgtcattgcaaattttttagggcttggctggggtgcaacacctctgggattaaaagcaatggaagaacttgcaaaactggaagaagaacgaaaagggaaaaaacccaaatccgccagcaatgaaatgtgtacatttttgattttaaatatttcatcattacagttgataccggtcaatgtcattgcctatcgaagccagtacggaagtgcaaatccggcaggggtgacaggtccggcaatcgtggcaacatttgtcagtacgcttgtggcaatattgttttgtaaatggatggatcgataaaaaagcagtctgcttaaaatttaaccaaatcaagtaagtcccctgcttcaattgcgaaaagcaataagcaggggtggggacttgcttgtatcaggagggggcaagccccttctgataagctgcgtagcagctatttggttatgagcaagtagcgaagcggattgcgaatatccacttgactgcagactgcttttagtacattattcttctttatgtgtgctgaagaattgtttctgacggatatagtaataaataataaacaggatagatgtaacaccccaggagatcggatagcacatcagaataatttggattcctgaaaaatgcggtacaacaaagaaaatccataaaatacgaagtacgcagacaccgccacaggtcatcagcatgggaatcataacatctccaatcccacggagagcacttgagaagatttcaataaagataaataaaacatagcttggtgcaagcaaggaaataatttccattccgactttgataacgccggcatcctgcgtaaagagccggaagagatagtttccaaagaaaatcaaaatcaggcttacaagcagagaggcagcaaggtccatcaaaagacagacagttacgcttcgtttcatccttgaatattttccggcaccatagttttgtccgacaaacgttgcaatcgaaaccgaaaatgcaccggaaatcatccagtaaaaggcgtccatttttccgaatgcagtataggctgccattgcatctgttcccagatgatttaaagaggactgaataatgatattggcaatattgtacatcatagattgaaagcctgccggaagtccgattgtaagaatagagaaaagcaaaaatcggtgcaggcggatttttttcggttcaagctgatacatttcttctggtttcatcaaagcacgaattaccaaaatggcactgacagcctgagaaaataaggttgcaagggcagcgccggtaatgccaagattaaatccgacgaccagaaaaatatccaaaaatacattaataaagcagcagacaatcagataataaagcggtcgtttggagtcacccatggcacgcagaatggccgaaccaatattgtagacaaagacaaagaaaattccggcaaaataaatacgcagataaatgacagaaccggtcattacatttgacggagtattcataaaccggagcatagcgggagcaagtaaaattccaaatacggtaattatgatgcttccgataatggcaagggctgaagctgtatgcagtgccagatttaattcttttttattctttgcgccatagtagcgtgcaatgatgacggttgcaccggaagaaagcccgacaaagaatccgacaacgagattgattagctgtccggaagagccaccaacacaggcaagtgcttcttttccgacgaagcgtccgacaataatggcatcggcagtattgtaaagctgttgaaataatgttccgagcataatcggaaaaaagaaaagcagaagctgtttccagataacaccctccgtaatttgattgacagcagaagttttttgtttcatgactacaccccctggttaaaaaaataaatcaatctgctacttacatatatagcatacaatttcacgaaagtcgatatcatgttttacaaatttttggcgaaaatgtggtataatagacacaagaatttttttgaaaggtgatgttaagtatggaggtaaaattacgagtagcagacccggccggaaatatcacaatttttgttaccagtccggtggaaagaaatttatatgcaaaggttgcaaatgaactgttagcaatcaaagagttccgtggagaacaggttggtttcattgaaagacatgaagatggaagcagtcacatggaaatgatgggtggagaattttgtggaaatgcaaccagaagttttggctatctgcttggaaaggagcaagagtcaaaggacgcctacaaaaagacggtaactgtagatgtcagcggttcttctgaaaaacttgacgtggaagtagattatgaggcaggaacaagtaaaaccatgatgccgcttcctgaaaaaatagaagaagtggaaactgctcagtacggaagctatccaatggttgtctttgacggaattaatcatgtaattgtaaaaggtccaagaagagaagatgcgtttgtacaggcggtgcttgaagctgcaatggcaaaacataaatgtgatgcgtgtggaattatgttcttagagccaagtgcagatggaatggaaaaacgttaccggatgacaccggttgtctatgtagaagaaacaggttctcttgtatgggaaagcagttgtggaagcggaagtatggcaacggcggtttatttaagcaaacagaagaatgatggaaaatatgtttatattttaaaacagccagggggaattattgaagcaacggtcgtaaaggaaaatggaaaaacagtagaatgtaagatgggcggaccggtttctgtttcattagaaaaaacagttgaggttaaggtctgattgatgaagcggtatcgtctgtgtaatccgtttccatcaatcgaaaaagaaggcagtctttcttatgggggaaatcagaattggagcagttctaagactattcgcaaatgcggatgcggagtgattgcaggaacggatttattgttgtaccttgatttaaataaacaaagatgcagaacaaagttttttgaagaagtgcaggattcaaacggaattatcgaacgggaacagtacttaaagtatgtccataaaatgagacgagattatcttccgctgattccacactttggtatgccgggatgggtgctggtagtgggcttaaatgcttatctggcaaaatatcacaccggcttgacggcaagctggggatttggacgcaaaaagttatggaaccgcatgagtgccatgctatctcatgatattccggttattttatccattggtccgaatctgccatttttccggaaaaaagaaaaactgaatctgtatcagaaaaacagtatgggaagctatctttcctcgaataaggtatctgcgcattttgtgacagtcacagagatggacgaagaatggatgcgggtttcttcgtggggaaaagagtactatattaataaaaaagagtatatcggctatatgacaaagtatagcaatgcattattttgcaatgtgtgttacatacgaaagcggaaatagctgaaaaaattcaaaaatctaaaaaaattatacattgcatttttcttgattttggtatatcatcctaatcataacaatcgacaaaaaattaacgagcataagaaaagcggaggagtataccatgaaagagcaaatcatatcctttaagacagtagaagaaattaaagaatttgtaggagcagcctgtaattgcccgtttgatatcgacgtggtaagcggaagaattacaattgatgcaaaatcaattctcggaatgttaagtgtgaactggcaggaagaactttgtgtcatctatgaagcacagaatgaaaaatttgatactgttgtgcagaaatatgcggttggataatgcatctgctacctttacaaaatcagaaaaatgtgttagtctctaaaaagatgacaaacacgatgacggagagagtacgcattgcttttcttttacagagaaattccggtggctgagaggaatgaagaaaactttggggaagatggctcctgagaggtgcaccgaacctgtaatttagtaaaatcaggtaaggctgcaacaggttccgcctgttatagcgggagaggtgtgaaagcacccattaaggtcttggctgtgaggctaagataaaaagaagtggtaacacgggtatatagctcgtcttctttcattctgaaatcaatcaggatgaagaagatgagcttttttggtttgtcaaaaaaattgattcaaagaaacccgttaaacaaaaatgtacgctcggaatctttctgtgtttgattctgtgagcacatagaaaaaagtaaaggagaaaaaatcatggataagaaaaaatattatattaccacagcgattgcctatacttccggcaaaccgcatattggaaatacttatgaagcagtacttgcagacagtattgcaagatttaaaagacagcagggatacgatgtattcttccagaccggtacagatgaacatggacagaaaattgagttaaaagcagaagaggcaggtgtaacctgtaaagaatttgttgataaagtatctggagaaattaaaaacatctgggatttaatgaatacttcttatgataaatttatccgtacaacagatgctgaccatgaaaaacaggttcagaaaatctttaagaaactgtacgaccagggagatatctataaaggatactatgaaggaatgtactgtactccttgtgaatctttctttaccgaatctcagttagtcgatggaaaatgtccggactgcggacgtccggttacaccggcaaaagaagaagcttatttctttaaaatgagcaaatatgcaccgagactgattgaatacatcaacgagcatccggaatttattcagccggtttccagaaaaaatgaaatgatgaacaacttcctgcttccgggacttcaggatctctgtgtttccagaacttctttcaaatggggaattccggttgattttgacccgaaacatgttgtttatgtatggttagatgcgttgaccaactatatcacaggaatcggttatgactgcgatggaaacagcacagagcagtttaagaaagactggccggcagatttacatctgattggaaaagacatcatccgtttccataccatttactggccgattttcttaatggcacttgatttaccacttccaaaacaggtatttggacatccatggctgcttcagggcgatggaaaaatgagtaaatccaaaggaaatgttatttatgcagaccagttagttgatttctttggagtagatgccgttcgttattttgtactgcacgaaatgccatttgaaaacgatggtgtgattacatgggaattaatggtagaacgtttaaattctgaactggcaaatacccttggaaacctcgtaaatcgtacgatttccatgtccaataaatattttggcggagaagtaagaagtacaggagtgaccgaaccggttgatgaagaattaaaatcagttgtacttggaaccaagaaaaaagttgcagataaaatggaagagctgcgtgtcgcagatgcaatcacagaaatctttactctgtttaaacgttgcaataaatatattgatgagacaatgccatgggcacttgcaaaagaagaagataaaaaagaccgccttgcagaagtactctacaatctggtagaaggtatctgcatcggggcttctttactcgaatcctttatgccggaaacaacagaaaagattttagctcagttaaatgcaccgaagagaacttatgaagaacttgatacatttggtttatatccggctggaaacaaagtaacagaaaaaccggaaattctctttgctcgtcttgatatcaaagaagtgatggaaaaagtagaggcaatgaagaaaaaagaagccgaaaaagtcggaacagcagaagaaaagaaagaagaagcggtaattgaaatcgaagcaaaaccggaaattacatttgatgatttcatgaaaatgcagtttcaggtaggtgaaattattgcctgtgaagaagtgaaaaaatccaagaaactgctttgctctcaggtgaaaatcggaaatcaggtaaaacagattgtatctggaatcaagtccaattacaaaccagaggatatggttggaaagaaagtaatggtattggtaaacttaaaaccggcaaaacttgcaggtgtactttctgaaggtatgctgttatgcgcagaggatgaaaatggtaaattggcattaatgacaccagataaagagatgccggcaggtgcagaaatctgctaaaataagagaaaactttctgatatgtaaattacaacagacctccataggtaagatgaaaatcggactatgggggtcttttcctaaaaaggagaaagaaatgatatttgaaacacatgcacactatgatgacgaggcgtttgatggggacagagacagcctgatttgggcgatgcatgaacatggaattgataccattatcaatgttggggcaagccttagaggggtaagagaaacagtaaccttgatggaacgctatccatttgtctatggcgcaatcggtgttcatccggatgaagtcggagatttggatgaagaaaaaatcgcatggatgcgtaagctttgtgaaaaagaaaagacagttgccgtcggtgaaatcggcctggattactactgggataaagagagccatgaaattcagaagaaatggtttgtgcgtcagatggatttagcaaaagagatgagcctgccgattattgtacacagcagaaatgcggcaaaagataccatggatttgatgaaggcagagagggcggattatttaagaggagtgattcactgttattcctattctttagaacatgcaaaagaatacatgaatatgggatattatcttggaatcggcggtgttatcacatttaaaaatgcaaagaaattaaaagaagtagtagaatatgcaccgcttgattatttactgcttgagacggactcgccttatctggcaccggaaccgtatcgtggaaaacgtaactgctcgttgtatttaaattatgtggcagaggaaattgcgagaattaaaaaaatttcttatgaagaagttgtcgagacaacgaagaaaaatgcgcaggaattatttggcgtaaaataagaaaaaatagagaaaaataagcaagaagaaggcttgcttttttatataccgattggtataatagagtacaacaaagacatgcagacagccggagggcagtttatggataataaagaattgataaaaaagtcagcgttgaaccttttttatgcaagaggatatgacgcagttggggtacaggaaattgtaaacactgcagggattaccaaaccaacgctgtattactattttggaagcaaacggggactgcttgaaaatctgctacagagtggatatcagcagttagaggatgaaatcctggacgcaattaataaaagcggagatttaaaagacgtgctttatcgtgttgcgcgcaccttttttgattattgtagcaagcatcagaaattctatttattcatgctgtctcttttttatctgggaagagaaaatgaagcttatcaggtggttgcacctctgattgagcggcattatagaatgatggttaaaatttttgaagatgcggcaggacagcttggaaatatgagaggacgtcaggaattatttgcggttggatttaccggtgtattaaatcaccacattctgactgtaaattacagtctgaaagaaggcgagacgtttcacatttcgaatgagacaacgtatgagattgtgcatcagtttttacatgggatttatacctgaaatggctgcggggtttgacagaaaaagaaaaaataaaaatataaatgatagaaaattatcagtttaaagaaggggaaagcttatggcgaaaaatcaaactttaaagattacggagatggatcgttatctgttcggtcagggaacacattatgagatttataaactcatgggagcacatccgacaaaacagaaaggaaaagacggcgtttatttcgcagtatgggctcctcgtgcacaggaagtagcggtagttggagattttaatggatgggatccaaatgaaaacattatgaaatgtgataatgacatgggaatttatcagcttttcataccaggagtcaaatctggagacttatataaattctgtatcacatcaccatcaggagaactgctttataaggctgacccttatgcaaattatgcagaaaaacgtccgggaaatgcttcccgcgtttatgatatcacaaactttaaatggaatgattctgtatggatgaaaaatcgtcagaactatgatgtaaataaacatgcgatgtccatttatgaagtacatccgggttcatggagaaaacatccgcagaatgaacatgatgaagatggattctataattacagagaacttgcacattctctggcagaatatgtaaaagatatgggctatacccatgtagaattaatgggaattgcagaacatccatttgatggctcctggggctatcaggtaaccggatattatgcaccgacttccagatatggcacaccggatgatttccagtattttgtcaattacatgcataaaaataaaatcggtgttatcttagactgggtaccggcgcattttccgaaagatgctcatggactggctgattttgacggcacaccgacttatgaatatgcagacccgagaaagggtgaacatccggactggggtacaaaagtatttgattatgaaaaaaatgaagtaaagaactttttgattgcaaatgcgctgttttggatggaacaatatcacattgacggacttcgtgtagatgcggtggcttccatgctgtatctggattacggaagagaaaatggacagtgggttccgaataaatacggagaaaataaaaacttagaagcgattgaatttttcaaacatttaaatacagttgtgcttggaagaaataaaggaacggtcatgattgccgaagagtctactgcatggccgaaagtaaccgcacatccggaagaaggaggtttaggattcagcttaaaatggaatatgggatggatgcacgatttccttgaatatatgaagttagatccgtatttccgtcaatacaatcatcataagatgacgttctctctgacttacgcatacagtgaaaattatgtgctggtattatcacatgatgaagtggttcatttaaaatgctccatgattaataaaatgccgggacttggacaggataaaatcgaaaacttaaaagtcggttattcttatatgcttggacatccgggtaaaaaactgctctttatgggtcaggaatttggacagtatcaggagtggagcgaagcaagagaactcgactggtatttaacagcagagtccagccatcgtgaattaagagactatgtaaaagagttgctgaaaatgtataagaaatatccggcactttatgcaacagaccacacagagggtgcatttgagtggattaatgcggatgatgcctgcagaagtatttacagttttatcagaaaatcaccgacaggaagaaataatctgttgtttgtcattaactgtacaccggtagcgagggatgattatcgtgtcggtgttccgaaaaagaaacagtaccgtctggtattaaacagtaaagacccgaaatttggtggggatgtgccggtagagaaaaccgtttatatggcacagaaaaaagaatgtgatggaagagaattttctttcgcatatccattaccggcttatggagttgctgtatttacatattaattagaggacgaagtttttggacttttggggtctgaaaactccgtagaaaaagattgtaaagaagcattaaaacagatagacgaaaagagatatacacaaatgttggagaaagaaggaatcgaacagattctgaaatatggaattgcatttcagacgaagaagtgttgtgtaagaagaggcgagttgtcataatttataccggatgtatccccaaaattgatgaaacaaaatatgatgaagtctggtggattgtccgttccccggataaaattcccacaatagaaaagctggtgcaggaactgagtccttcaaaggaagtatttaaagcatacagaaaggcattccaccttggaatctttgatgaagaatactttcaaactgtttatgtacctgattttttagacgaccttataaaaaatcaaagtgcgctagagaagcttggatggttgtgtgaaaaaagcagagaaaaaaatatcatactgggatgttactgtgaggaagaagcgctttgtcatagaagcattatagcgggaatattgcttggaatgggagcaaaaatagaaacgaaagcagagtatatcaaatattttaaccaaatcaagtaagtcccctgcttcaattgcgaaaagcaataagcaggggtggggacttgcttgtatcaggagggggcaagccccttctgataagctgcgtagcagctatttggttatgagcaagtagcgaagcggattgcgaatatccacatgacaacaatggagtttttggtttgagccaaaaactccattgttgtcattttatcatttgttttatcattcgtcgtagatgtttacaatttctccgtctaaaatacggttcatattttttacagcacagaagtttccacacatactgcaggtatcttctttttccggtttggcttcggcgcggtagcgtcttgctttttccgggtcaatacagatatcaaacatttcctcccaatctaatttctttcttgcaaggctcatctggtgatcccattcgatggcaccttttacgccttttgcaatatctgcggcatgtgctgcaatcctggaagcgatgatgccttcttttacatcatcaaggcttggcagacgcagatgctctgcaggagttacatagcagaggaaggaagctccggatgcagcagcgattgcaccaccgattgcagctgtgatatggtcatagcctggagcaatatccgttactaaaggtccgagtacatagaaaggtgcacccttgcagatagttttctggatttccatatttgcggcaatctggttcattggcatatggccaggaccttctaccataacctgtacgtctttttcccatgcacgtgcggtcagttcgcctaaagtaacaagttcttcaatctgggagatatcagaagcatcttttaaacatcctggacggcaggcatctccaagactcatagtgatatcgtattcacgacaaatgtcaagaatttcatcataatgttcatagaatgggttttcttcaccggtcatttccatccatgcaaaaatgatagaaccaccacgggaaacgatgttggtaagacgacggtttgctttgaaacgtcctgcggtggctttattgataccacagtgaatggtcataaagtcaactccatcttccgcatgcatacgcacaatatcaatccattctttggaagtgatttcttttaatggtttgtggtaataaacaactgcgtcataaatcggaacagtaccgatcatagccggacattctttggtaagacgtttacggaaggtgcgggtatctccgtaagagcttaaatccatgatagattcagcccccattttgactgcattgtttactttttcgatttccatatccatgtctttccagtctctggaaattccaaggtttacattgatcttggttttgagcatagaaccgatagcgtttggttcgattgaagtatggagtttgttacaaggaatgataacctggccttttgccatatattccattaattctttgacatccatgttttctttttttgctgcgatttccatttcttttgtgataatgccttttcttgcggcatccatctgtgttgtgtattccataatacattttctcctttcgcatttgattgataagcttttgtttgaagacgtttagctaataaaaaaaggtgcaccccgacaggtacaccttaatcattcacataaaatatgcttcctacgccggcattatccgtatcaggttcatagggtcgaaatccgttcgtatttcttctcaaccgacgcgtcagctccccttttctttgttttttatatcatatcgtctattctgatatttgtcaagcatagatataagaccatttttttaaatctttgataaaatcttcaacagcctgttcatttgttgcccaggaggtgcagaaacgaagacaggtatggttttcatccggtttgcactggaaagttgtgacataattctcattgatttttttggcgaattcattcgggaaaatcgggaaaagctgattggtaggtgaatcgcataaaaatggaatcttgcagtcgataaagccttcttttaaacgctgtgcaagtgccacactgcgttttccaagttcgagatataaattatcctggaaaagttcttcaaactgtacgccaatcatccaacccttggcgagaattgcaccacgctgtttcatattaaaacggaaatgatcttttaaatcatcgtttactaaaatgagtgcttcaccaaacattgctccgttttttgtaccgccaatataaaaggcatcgcataaatccggcagatcttttaaggtcagctgtgtttcttctacggcaagtgccatggcaagacgtgcaccatcgatataaagatacagattatggcgtttgcagaactgataaagtttctcaagttcttcttttgtgtagacggttccgagttcggttgggagagaaatatagaccagacgaggttctacccaatgctcattttcgtgctgttttaagaccggacgaatcaggtcagcagtcagttttccatcggtacaaggaatagagagcactttatgtccgcttgcttcgatcgctccggtttcgtgtgtattaatatgaccggtatccgcactgatgactgcttcataagggcgcagagcatgcgaaagaaacgtaagattcgtcagcgttcctccggtaatgaaatgaatatcaactccataattttccagtgcttcctggattttatcgcgggcattatcgcaatgctcatctaatccgtaagaattattttggtggtagttgatggtttcaagtgcgcgaagaatatttggatgtgctccttcgctgtaatcattctgaaaactgtacataataaaaatccccttttttcaacaacatctttcatctcattctaacacaattttcgtaaaaagaaagtgaaaagatttagaagagaaaattaattgacgatggactggacaatttcgagttagttgtggtaaaatcctaaaatagatgataaacaggggcggaagtactgaaagtggaactttcgtccccttttaccgtgctatacaaaatgtactcttggagtctttaaacatttgttttggaaaggaagtaattgaagatgacaaaaattgatattttttcaggatttcttggagcaggtaaaacaacattaatcaaaaagttattaaaagaggcatataaaggcgagcaggtcgttttaattgaaaatgaatttggtgaaatcggtatcgacggcggtttcttaaaggaagcaggagtagaaattcgtgaaatgaactccggatgtatctgctgctctttagttggtgactttggaactgctttaaaagaagtaatcgcaaagtatgaaccacagcgtatcgtaatcgaaccatcaggagtcggaaaactttctgatgttatcaaggctgttcagaaaatcgaaaacgaagttgaaatcaaattaaacagctttacaactgtagtggatgcaacaaaatgcaaaatgtatatgaaaaacttcggtgaatttttcagcaaccagattgaatatgccggaactgttatcttaagcagaacggataaagcttccgaagaaaaaattgcagcggcacttgagattatccgtggactgaatcagacagcagcagttatcacaactccgattgaaaaactttccggagaaaagattttggatacaatggaaaataaccgctctttggaaaaagaattaatggatgaagaagtttgcccggtatgtggtggacatcatgaccatgagcaccatcacgaccatgaagaatgtggatgcggacacgaccatgagcatgaccatcatcatgaccacgaccatgaagaatgtggatgcggacacgaccatgagcatgaacatcatcatgaccacaaccatgaagaatgtggatgcggacatgaccatgagcatgaacatcatcatgatcacgaccatgaagaatgtggatgcggacacgaccatgaccatgatcatcatcatcaccatcatgcagatgaagtgttcacaagctgggggaaagagacaacaaagaaatatacaaaagaaggaattcatgagattctggaagcactctctaaccataatgacgagtacggaatggtactgcgtgcaaaaggtatggtagagggcgaagatggacagtggatttactttgatatggttccaggtgaagcagatgtacgtgaaggtgcaccggaatacaccggaagaatctgcgtcatcggttctaagatgaatgaagcaaatctggccagattatttggtcttgcataatcaagatacgagagaaaaataacaatacaaataagcttaaggtgtgagtgttgaactgaagttttgacactcacatcatgatatttaagaaaggttatgaaaaatggacgaatttaaagtaccgatttaccttatgacaggttttcttgagagtggaaaaacatcatttttgaattttacactcgcacaggagtattttcagattgatgaaccgactcttttaattctctgtgaggagggtgaagaagaatacgataaaaaagtgctgaaaaaaagccgtacttctgtagaagtaatcgacagcattgaggagctgaccacagagcgtctggttgcttatgatgcattttataatccgggtcgcgttatcattgaatacaacggaatgtggcaggtaagcaaattagaagaactgacatttccgtctggatggggaatcgaacagcatattgtgacagtagatgcaagtacctttcaggtataccttaacaatatgaaatccctgtttatggaaatggtaagaaatgcagatttagtattatttaaccgtgcagataccgaacttccgcttgcaaatttcagaagaagcattaaagttgtaaatccgggtgcagaactgatttttgaagatgaagagggtgaaatcgaggatatctttgacggagaaatgccatttgatgtcaaggccgagacgattgaaattccaaatgaggattatggaatctggtatctggatgcgagagaccatgcggatacttataacggaaagaaagtttcttttaccggaatggtgttaaaatccagagaatttgctaaaaatgaatttgtaccgggacgtatggcaatgacctgctgtgcagatgacacaacatttttaggatttgtctgcaagagcgatgaagcacgtcatctaaaaaccggaaaatgggtgaatgtcgtagccaaagtgaaatatgaatttgtaccggcttacggtgaaacaggtccagtactctatgcgatttctgtggaagagacagaaccgttaaaagatgaactggtatattttagttaaggagctgatatgtatttaatagtaggacttggaaatccaggaaaacagtatgataaaacccgccacaatatgggatttgataccattgatgaattgatagaccgtcatcggattgccggatctggaatcgaccggaaagcgatgtatggcaagggagtgattgccggagaaaaagtcattcttgcaaagccgatgacctatatgaatttgagcggagaagcagtcagggaattaatcaattattataaaatggatgcagagacagaactggttgtcatctatgatgatattgatttggacccgggacagataagaatccgtaaaaaaggcagcgccggtggacacaatggaatcaaaaacattattgcccagcttggaacccagaatttctaccgaattaaagtaggagtcggagcaaaaccaaagggatgggatttggcagattatgtactgggacgttttgataaagacgaacgtgttctggtcgatgaagcaatcaaagaagctgccgatgcagtggaattaattttagcagagggcattgaaactgccatgaaccgttataacgcaaaaaagaaataggaatgaaataaataaattgagggagaaaacatgcaggcacttttgcagccactttcaaaacttggtgaatacgaagaaattaaaaacagaatagagaaaaatcgtgggattttacagcttgccggatgtattgattcgcaaaaagcgcatgtcatttatggactgggtcaggaaaagaagaaccgtcttgtcattgcggaaaatgaattaaaagcaaaagagttgtacgaagatttgaaattttactatccggatgttttttattatccggcgagggatttaattttctttgaagcagatattcatggaaatctgctcacaaaacagcggatgcaggtaattgcagcacttttggagaaaaagagtgtgacggtggtgacaagcatcagtggctgtatggattatcttcttccgatttccgtacttaaaaagcatgtcctgcattttaaaaatgacagtgtgcttgataccgaagcactcaaaaaagagttgattaatatgggatttgagtacaatgcgcaggcggaggcaccgggacagtttgccatgcgtggtggaattgtggacatctttcttttgaccgaggaaaatccggtgagaatcgagatgtggggcgatgagattgattctatccgcagttttgatgccgaaagtcagcgttccattgaaaatctggacgagattaccatttatccggcagaagagatgatacttgatgattcggttttggaaaaaggtctgatatccattgaaaaagagcgggataagacgatacaggcatttcgggatgcctttttgccggaagaagccggacgtatcaaaaatatggtaaatgaagcagtcagcgcaatgcgggaatttcatgatttttcatcagcagaacattttatccgatatttttataaagaaccggtcacttttttagactattttgaggaggaggatacactcctttttttagacgaaacaaatcatcttttagcaagtgtggaagcagtggaaacggaattccgtgagagcatgaagcaccgccttgaaaaaggttatcttctggcaggacagacagatttattatgcgggaaaaaactgctgattcataaaattaatcagaaaaacggcattggaatctgtacgatggaacagcagaaagaggactggcagataaatgattccttttatctgacaaccaaatcggtaaattcgtataataacagttttgaacttttaataaaagatttgaaaaactggaaaaaacggggatatcaggtgttgctgttgtccggttcaagaacaagggcgaaacgtctggctcaggatttattaaatgaaggcttgacggcggtttatacggaggatagaaatcgtgaaatccatgagggtgagattgtaacgacgtatggatatgccagaagcggatttgagtatccgatggtgcgttttgttttgattactgaaagcgatatcttcggaaaagagaagaaaaagaagcgaaagaaaacagaatacagcggaaagaaaattcaaagtttttcagaactttcgattggtgattatgtggttcatgaaaatcatggattgggaatttaccgtggaattgagaaagttaccgtagataaagtagtgaaagattatattaaaattgaatatgcgggtaacagcaatttatatattctggcaactcagttagatttactacaaaaatatgccggagcggatgcacgtgcgccgaagttaaataaattaggcggtcaggaatggaacaagaccaaaacaaaggtgcgtggagcagtaaaaaatattgcaaaagatttggttgctctttatgctgcgagacaggagaagaatggttactgctatgaaccggatacggtctggcaaaaagagtttgaagaaatgtttccatttgaggagacggaagaccagttagcggcgatcgaagcgactaaaaaagatatggaaagtaacaagattatggatcgtctggtctgcggggacgtcggatatggaaagaccgaaattgcaattcgtgcagcatttaaggcggttcaggaagataaacaggtggtctatcttgttccgacgactattcttgcacaacagcattacaatacctttgttcagagaatgaaagattttccggtgcggattgatttgctttgccggtttaagacttcggcagaacaaagaaaaaccattgaggatttgaaaaaagggtttgtggatatcgtaatcggaacgcatcgattgttgtcaaaagatgtggtctataaagatttgggaatgttgattgtggatgaggaacagcggtttggcgtgactcataaagaaaaaatcaaaaaactcaaagaaaatgtggatgtattgacgctgacggcaacaccgattccgagaaccctgcacatgagtctgattggaatccgtgatatgagtgtattagaagaagcgccgatggatcgtatgccgattcagacttatgtgatggaatataacgaagagatggtaagagaggcgattaaccgtgagctggcaaggggcggacaggtttattatgtgtataaccgtgtcaatgatattgatgaaatcacaaatcggattgcaaaactagtgccggatgcaaatgtagcctttgcacatggtcagatgccggagcatcagttggaaaaaattatgtatggatttatcaacggagaaattgatgtgctggtatccacgacaattatcgagactggtctggatatttcaaatgccaataccatgattattcatgattctgaccggcttggtttgtcccagctttatcagcttcgtggtcgtgtgggtcgttcaaacaggacttcttatgcctttttaatgtataaaaaagataagatgctaaaagaagttgccgagaaaagattgcatgccatccgggaatttacggatctgggaagcggatttaagattgcgatgcgtgatttggaaattcgcggtgcgggaaatcttctgggtgcagaacagcacgggcatcttgaagcggttggatatgatttgtactgtaaaatgctcaacgaagcggttcaggaagaaagaggaatggaacaggcagaagagtttgagactacaattgatttggagatggatgcctacattccgccaaaatatattccaaatgaatatcagaagctggatatttataaacggattgccggaattgaaaatgaagaagaatatgaagatatgttagaagaactgatggatcgttttggagaaccgccgaaggcggtacagaatttgcttgcaattgcaaatttaaaggcgcttgcacacagggtttatgtaagagaaattaagcagatcaatcaggaagtaaaagtaacgatgtttgaacgtggaaagttaaaaacggaggggattcctgcaattttagaaaaatataaagaccggatgtctgtgcggacaggaaaagaattttatttcctgatttccctgaaaggaagaaaagcgaaagagttctataaggcgctcgacctggttttggaaattctccatgagtttgaggcattattaccagaaagttcacaaaaaatcccttgctcaaaggaacaataaagattatacttaacaagtacaccaaaagtacatcaaatatcgaatggaaatgaaaatacgggaggaattatgaataaattaggaagggttcttgcctgcacgactcttgcggcaacattgacaatgaccagtttgactggatgtggaagtacattagatggaacgaagacagtagcgacggttggaaaggaagaaattacagccggaacagtgaatatgatgcttcgtatgacccaggctcagatgatgtcttactattccatgtttggaacatccactacaggaatgtgggaaaataaaggcgatgatggcaaaacttatgcagaaagcaccaaagacgacattatggatcagcttcataatctggtattgttagaacagcatgcaaaagattatgatgtaactatcacagataaagaacagaaagaattaaaagccgcagcagaaaaatttatgacagataatgatgcagaaacgattgcaaaactcgcagtgacccagtccgacattgaaaaactgcttgagttatacagctatcagacaaagatgtatgacccgatgacagctgatgtagatacaaatgtagaagataaagaagcacagcagagtaaaattacgtactgcaaagtttctacagaagcgactaaagatgatgagggaaattctacagagttgacagatgaagaaaaagctgcaaagaaagaccaggcacagcaggtattagataaaataaaagcgcaggaagatattgccggcgcagatgtggacagtcttgcaaaagaagtggatgagtcgcttagttcgtctactgcaacttacagcacaaatgaagacgataaagattcctctcttgatgctgacgtaatgaaagcagcaaaagaactgacagaagatggtcaacttgcttctgatgtcatcgaaggcagtgacggatactatgtagtccgtatggacagtgtttttgataaagattctactcagacaaaaaaagacagcattgtaaaagaaagaaaacagaaagcttatgataaactgcttaaaaaatgggcaaagaaaacgaaaatctcagttaataaaaaagtatggaaaacagtaacattaacagatgaagatgtttacagcttcaaacaggctgatacatcaagcgaaacaacagacagtacagattctgcagaaacaacagaagcaacagaaaatacagatagttcagaagcagaagaaagcactgagacaacagaaaatacagaggaatcctctgacagcacacaggcagatgaaaattcagatgcaggtgaaaatgctgatacagaagcaaccgaaacagctgaataataaaaaaagtccgttatcactatttatatttaggtgataacggactttttaacttataaacgactctggcggaatttttttcgataatcccttggggtcattttttgtgctttataaaaagcacgtgtaaaatagttctggtcattataaccacagtgaaatgcaatttctccgatactcaaatcagaagattccaataagcgacggctgtttttcagccgaacctgactgatatgagtatgaatggaaattccgtaagtctctttgaattttctggtgagagaggaacgactgcagaagaactgggagcagaggttatcaatggtgatatgctgtccatagcgttcttcaatgtagctgtggacttctgaaaccaactcttttttcgttaactgcatacggtttgtcagagtaatatactgagcgcagatttccatgattgtaacaagggagtcgattgtctgacggtcactgaccggaatctgggcaatcgtatcctgcaacaattcatagtcatcttttttcatataaggaagcgcttttttgaatgtctcttttgcagcttcttttcctttgttgatggtctgacccatcatcagatatccggttaaagtaccgaaactataaagcggggcaactgcctcatatagccctaagtggcatttataaatgtgaagccgtttttcatcctgtactttacgaaatgccatgatatcctgttctacgcagtgttttcgacctttcggattttcctgtatcagcgaacagagacagccgagttctttcgggaaagcagcaatttcctgaaaataagtatcgtaaacactgatacggaagccggatatatgataaagttcttttaaaatcttttcgattgaaattgtctgctccataaagaattcctccttaaatttcagttgaacagaaaaaatttagatgtattttgtgacaatctgtttcatatcatccattttacgttccatgtcagcaaccagaatcatctgagtgcgagtgcggtcaagattatgatgttctctttggattttaaagtaggtatctccatttaaataatcagtaaggaaacgaagtccacattcgagagtcatcagttttgcagaaaatggaatcagttcaatttcttctttcgttaaagaatcgcctgcttcagaaagaaaaccggcagtgtaagcttcaaagagttctaagctcatggaaactttggttaaatcaatttcatcttcggcagcagtgcttgcgccaaaacggatgctgtcaccaaaatcgtataaaacagaaccaggcattacagtatccaaatcaatgacgcagattccctcgtttgtggtattgtccatcataatgttgttcagctttgtatcattatgggttacacgaagtggaagttttccggcattgatggcatcaactactgtttttccgtcggtttcacgctccagataaaattcgatttcctgctgtacattttttgcacgaccttttttatctgcttttatggccgctttaaaatcttcatagcgggatggagtgttatggaaatttgggatgatttcatgcagggtgtcagctggatagtcggcaagcagtttctgaaaatgtccaaacgcttttgcggcatttttgaagatttcaggagaagaaacggtctgatagcaggttgcatcttcaataaaagtatagcttctccagtaaaccccttcgctgtctttaaaaagggaagagccggattttgtaggaataacagtaagagttccacggcttgggtcttttccctgctcaattagttttttccttaagtgagaagtaacgccttcaatattttccatcaatccataagggtctttaaaaatagaagtattgatagcctgaaggatgtagcggacaggtggtttcgtttcacggctgaaataaacggcaaacgtactgttgatgtgaccacagccaaatggttcttcataaataaatgtaccgttatacagaaactgaggtacgatttcattttttattttttcagagatagacatggttttcctcctgagctttaaattaaattcttatttcttaattatataaaaaagaaaagaaaattctatagaaaactgactcataaatagcaaaaacaggagaaaaagataaaaaatgctaaaatgaaagagggtgggatttttaaggctgatgcagagtataatgaaagaaagaataaaaatggggtgtacagggataagatgagagttctgctgtttttttcagaaatgataattccactgattttattttacgttgtcggtttcggtgtattaatgaaatgtgacatctatgaggaatttgtaaagggcgcaaaagagggcttagagacagtcattcagattcttccaacattaatcgggcttatggtggcagtaggagtcctgcgtgcttcaggatttttgaccatgcttggagaagtgctcggaaaggtgacagagccgtttggatttccgtcggctttagtaccgcttacaattgtgcggatgttttcttcaagtgcggcaacagggcttttacttgatgtttttcgggaatttggaacggattctcgaaacggaaaaattgcttctattatgatgtcgtgcacggaaacaattttctacacagtgtcggtgtactttatggcagcaaaaataaaggatacgagatacacgatagcaggcgcatttcttgcttctgcggtgggaattgctgcaagcgtatggcttgcaggctacatggggtgaaaaaggttgacaaccccaaatttagatgttactatggtagcacgttaaaatatgaaaaatggatattataatggagtgagcgagagaacccacggttttaatcgtttgaaaatacatagaaaggcaagggtcgaaaaagaaaaatgagatattatgataagataacaccagatggaacaaaagatttacttttcggtgaatgtgaacagcgttcacaggtaacaaagaccctgaaggacttgtttacagcccaggggtatcggagggttatgacacccgcacttgaattttatgatgtatttggaaaatcagcggcgaaatatctgccaaaggaaagtatgtataaactgatagaccataaaggaagactgatggtactctgtccggattgtaccgtacctgtggccagattgacggcaaccagattaaaaggaatgccgatgccgcttcgtttattttataaccacaatatttaccgtatgtttccggagttaaaaggaaagagtacagaaatcaatcaggtgggaattgaactgattggcggagaaaaattaagaagtgaccttgaagtggttgaacttgcagcaagatgtttaagtaccatcggaaatggaaaataccgtctggaattatgtgatatcggttactttaaggcgattatgaacagcctggatgtggatgaagacaccaaagaagaaatccgttatcagattgaacagaaaaactatgcttcgcttacagatatgcttggaaaatacaaagacagcaaagcagcgcaggcacttttgaagctgccaagattatttggcggtgcagaagtatttgaaaaggcgtatgaactatttgatgaaaatggcgcaaaagaaagtctggattacttaaagggaatttatgaatacttgcaggcactgggacttggtgatagagtaatcatcgatttgggacttgttaacctggcagaatattataccggaattatcttccgcggttatttccacggaattggagagcaggtgctttcaggcggtcgttacgaccagcttctgcatgattttggagtggaagaatgttctgtcggatttggaatcaatgtagatttggcaagccagaaagtaaaaacggtagaggaaaatataccggaagtgctggtatttgcaccggatacgaagtttttggcaaaagcagtccatcatcgcagagaactggaagaccagggcatgctgacggaaaactgcgtttttgatacaatggaagaagcatttgattatgcaaaaatgagaggaataccgaaagtgcatctggtgggagatgatattaccgtttgtttaacgaagaaaaaataggaagtatagctactcactgggaggcaatgaaagatgaaaccaattagaattgcgcttacaaaggggcgtttagaaaataaaacagtagaacttttagaacgtttaggatatgactgtaccaatgccagaaaaaaaggcagaaaattaattatgccaattggaaatggtgaaatcgaagtcgtgcttgcgaaagcggccgatgttgttacttatgtagaaagtggtgtctgtgacatgggtgtagtcggaaaagataccatcatggaaaaaggcggaacattttatgaagtggcagatttaggatttggaaaatgtcgttttgctgttgcaaccttaaaagagaaagacttatatgaaggctatcgaactttaacgattgcaagtaaatatgtcaatgtcgcaaaaaattattttgaacaaaaaaacatggatgtagatgttgtaaaaattgaaggatccgtagaacttgcaccggtacttggacttgcagatgcaattgtagatattgtggaaaccggtacaactttaaaagaaaatgggcttgttgtaaaagaagaggtgtgtccggtcagtgccagactgattgttaacatcgcaagcatgaagcttagaaaaaaagaaatcgaagaattaatcgataaaatcgaaaaagatattaaaaaaagagcaaaggaggcctagaaaatgacgtatgtattaccggaaaaattaaaagacttaaatccttacgaccctgtaacggaggattttcggatccatcttgatgcaaatgagagtttctgtgaagtaccggaaaacatcaggcaggaaattttaaatgcggtttctaatgttgcatttaaccgttatcctgatccgtacgcaagaaaattatgtgaaaaagcaggtgcatattatcatgtagacccgaaacttttaactgccggaaatggttcggatgaattaatttctctggtagtaccgtattttctggacgagggtgatacgatgcttgtcgcagtaccggatttttccatgtactggttttacgcaccgtttcacaaaatcaaagtagaatcccttcaaaaagaaaacagcatgaagacttctgcagaagagattttacagcgtgcaaaagagaaaaatgcaaaattgctgattttctccaatccgtgtaatccgacttctcttggaatcggacgtgacgatatcataaaaattatcgagggtacagatgcgctggtgattgtggatgaagcttatatggaatttgaaaacgaaaataattccgtcttaaacgaagtagaaaattatgataatttaattgttttaaagacctgttcgaaggcatttggaatggcagcaatccgccttggaattgcagttaccaacgaaaagctgacaggaattttacatgcaatcaaagcaccgtataatgtcaattccgtgacacaggcaatcggatgcgtattattttctcacccggaatatctggcttcctgcattgatgctttaaaggcatccagagacgagttatatcaggcggtgaaagcgatggaagataaaaaaacagaaatcgaaaccgtctacgagacgagtacaaactttatttttatgaaggtaaaacgtgcaaaagaagtgtttgaagcattaaagcaaagaggcatttcgattcgatttatgaatggctatcttcgagtaaccgcaggaacaaaagcagaaaataaagaagtgatggaagcactttgggaactgattcagtaggaggcggatatgagagaaaagcagattataagaaccacaaaagaaacagacatcaatctgactctgaatttagatggaagcggaacgtataacggaacttgcggagttggattttttgaccatatgctgagtgcattttgtgttcatgcggggtttgatttagaccttaagatgaaaggcgatttggaagtagactgtcatcacagtattgaagatttgggaattgtgctgggacaggcatttgcggaagcagttggtgataagggaagtatctgccggtacggaagtttttatattccaatggatgaggcacttggtttttgttccctggatatcagtggacgtccatttctggtatttgacgcagagtttaccaatcaaagtgtaggaacattggactgctgtatggtaaaagaatttttccgggcatttgcatttaacggcggaattacactgcatttgaaatgtttgtacggcgaaaatgaccatcacatcatagaggcattatttaaggcagtggcacatgcattaaaagaagcagtaaagccaaatggcggacaaatcttatcttcaaaggggatgctggcatgatagcaattattgattatggggcaggaaatctgtttagtgtaaaaaatgcattggattttttgcaaaaagaaagtacaataacagaggatgcgcaggaaatccgtaaggctgatgcaatgattcttccgggagtcggagcatttccggatgccatgcgcatgttaaaagaaaaaggacttgataaagttatctgtgaagaagcacaaagaaaaccgctgcttggaatctgtttaggcatgcagatgttatttgagacaagctatgagtttaaagaaacaaaagggcttggactcttagaaggcagtgtcgttccaattgatggaggcggattaaaaattcctcacatgggatggaataatctgaccgtattaaatccatgcaagattacggaaggactaaaagaagatgcttatgtgtattttgtccactccttccgtgcagaaacaaaagacgaaaatatttcctgctatacgatgtacaatgagaaaattccggcacttgtgcataaaggatttgtatatggagcgcagttccatccggaaaaaagcggttcggtgggactgggattactcgaaagatttgctgatttagcgaaaatacaggaggaagagcgatgattatattaccggcaattgatattaaagataaacaatgcgtacgtctggtaaagggagattatgcaactgctcatcaggttgccgaaagcccttatgagactgcaaaatcttttaaagctgcaaatgcctcctggattcacatggtagaccttgacggtgcaaaggaaagaaaaccagtcaatcaggagatttttgaacgtgtggcaaaggaatccggattaaaagtagaagtgggcggaggaatccgtgacatgaaaacaattgaatattatctggagcgtggaattgagagggtgattcttggttctgtcgcagtaaaaaatccggagcttgtaaaagaagctgtaaaagaatttaaagagtgcattgcggttggaattgatgcaaaaaatggaatggttgcaacagaaggctggctggaaaaaagcgatgtcagttatctggatttgggacttgcgatggaagacgcaggcgtaaagactattatttttaccgatatttcaagagatggaactttaaccggagttaataccgaacagcttggacgtttaaatgagaccgtatcctgcaacatcattgcaagtggaggagtcagttccatcaaagatattgaagattgcctggagttgaatctgtatggatgcatctgcggaaaagcactttacacaggagcattaaacttagaagaagcagtgcgaaaggcgggtgtgcagacatgttagcaaaacgaattattccgtgtctggatgtccgtgacggaaaagtggtaaaaggtgtcaattttgttggaatcaaagaagtcggagacccggtggagtgtgccattgagtatgacaaacagggggcagacgaaatctgttttctggatatcacggcgacccatgaaggaagaggaacaatggttgatgtcgtcagaagaacggcaaaacatgtttttgttcctctgacagtaggcggaggaatccgtacagtagatgattttcgtgagattttaagagctggtgcggataaagtctcggtcaattcagcagcagtcagacgaccggagctaattcgtgaagcagcggaaatctttggaagtcagtgtgtggttgtcgcaattgatgccaaacgagatgaaactggcacatttaaagttgtggtaaacggcggaagaattgataccggattaaatgccgtagaatgggcaaaaaaatgtcaggaacttggtgcaggagaaatccttctgacttcaatggatacggatggatgcaaagaaggatttgacctggaactttgcaatgccgtctgtaatgtggtcagtattccggtcattgcaagtggcggatgcggaaaactggaacatttttcggaagtgtttgaaaagagcggtgcagatgcggcacttgcagcttccctgtttcactttaaagagctgactgtcgaagaagtaaaagaacatttaaaggaatgcgaaattccggtaaggagatagagatggattttgaccgttattttgtaaaaggggagttgattccggcaattgtgcaggaagagggaaccggagaagttttaatgcttgcctatatgaataaagaaagcctgaaaaagacatttgagacaggatatacctggttctacagccgttccagacaggaactctggaataaaggtgcaacttccggccatctgcagaaagtggtagatatcaaatcagactgcgatgatgatacgcttttagtgactgtgattcagacaggtgctgcctgccataccggaaatcacagctgtttctttacagatatctggaaagaaggaggagaacgtaattagacgttttttaatgataacaggcaaggtgctcttggcacctttcctgttttgtttattttggatttcaagaatctttgaattatttttaaagatttcaagaccaattgttacgattctatgtgcaatcggttcggtaggaattacaatcggggcaatcatccatatttttttctatcttcagggaagaggaatcagtgtatgggggattgtcctttcggtgttttttgcagcagccctgatggttgtgccggcagcaggtgttggagtggtaatcgtagtgttggagggaatttgcaatggaatttatcgaatgtaccgtccggcgatggaaaagatgaatctggaagaagagaaaaaagattatcatcttgcggaatgtgagtgggatgaaaagacaccggacgctccctggaaaaataaagaagaatgcgaacgaagaattcattattttaaaggggtaaaagataaagaagaactggaaaaacggctttccgggctcttacggatttaccgaccagagaaagaatttgccgaagatgcactgacacgaagcattttggatgaatttgagtatctaaagggcaggcttccggagaaagcaaaagatgtatgatgaaaaatgcaaaaaccgcccgaagaaatcctgtccgagaagttgacaagaccttgaaaagcgatataataaaagaataaagaatgtttaaaattcaattattgtggaggaatttaaaatgaaagtattagttgaaacatctgcaagacatttacatttatcacaggaacatctggaaatccttttcggaaaaggtcatgagctgacagtgaaaaaaatgctgagccagccgggacagttcgcatgtgaagaaaaagtacaggtaatcggaccaaaaagttctttaaaaatgtctgtattaggacctgtaagaaaagatacacaggttgaagtatctttaacagatgcaagagcaatcggtgttacagctccaattcgtgaatccggtgatattgctggttcaggtgcctgtaagctggtaggtcctgctggtgaagtagaactgacagaaggtgtaattgctgcaaaacgtcacgtacatatgactccggaagatgcagaagcagcaggagtaaaagataaagacatcgtaaaactggacatccagtctccaaacggtcgttctttaacattcggtgatgttgtagttcgtgtaagcgcaagctatgcaacagctgcacatatcgatacagatgaagcaaatgctctttgcccaggtaaagaatgctacggtgaaatgattaaataattaaaaacagtcatgattgaaagtcctttagatgagaaaactcatttaaaggactttttttgattggaatcagaggcaaaatcagcgcaaaacgtcatacttgtgcaaaatgcaccaaaaccgtccatgattttcgtatattaataatggttgattttgattgattttgaatgaaaatgattgtataatacagtcatagcaagagagaacaagaaagaacagaacaggagggaaaatatgatttatacagttacatttaatccatcccttgactatattgtttctgtgaatgggtttgaacttggaaaaacgaaccgtaccgattcggaactcttattacctggaggaaaaggaattaacgtttcgattgttttgaaaaatctgggaatcgataatacagcacttggatttatggcaggatttaccggagaagagattcagcgcagagtcgaagagattggcgtaaaggcagatttcatttcaatcgaagacggaatttcaagaatcaacctgaaactgaaaaatattgagggaacagaaattaacggtcaaggaccaaaaatcagcaaagaaaaacgagaagaactgcttcagatattagataaactaaaagaaggcgatgtgctggttttagcaggaagcatcccatccagcttaccggatgacatttacaaaaacatcatgaagcgtctggaaaagaaaaacattctgattgcagtggatgctacaaaagatttacttttaaatgttttagaacatcatccatttttgattaaaccaaacaatcatgagcttggagaaatctttggagtggaattaaagacgagagaatccgtcattccttatgcgaagaaacttcaggaaaaaggagcaagaaatgtgctgatttctatggcaggagagggggcagccctcgttgcagaagacggaagtatttatcttgccgaagcaccaaagggaacactggtaaatggtgtcggcgcaggagattcgatggtggcagggttccttgcaggttggcttgaaaaacacgattacagacatgcattccatacaggaatcgcagccggaagtgcaagtgcattttccgaatatctggcaagcagggaagaggttcaggctgtgtatgagcaggtaacatcaaaagaatataaagaacaataaggaaagagagggagaagtaaaggtatgagaattacagatttactcgatgcaagaagtatttcgcttgactgttcgccaaaaacgaagcaagaggcattggatacagcagttgccctcatggtaaagagcggaaaaattaatgacgaagaagcttacagacgtcaggtttatgcaagagaagaagaaagtacaacaggaataggagaaggaattgcaattcctcatggaaaatgtgatgccgtaacaaaacctggtctcgcggcaatggtaatcaaagatggtgttgatttcgatgcattagacggagagccggttaccctgctgtttctgattgcagcaccaaatacaaaagataatgtacatctggatgtattaagtaagttatctgtacttatgatggatgaagatttctcaaatggactgagaaatgcaaaaagtgtagaagaatttttgaaaatcattgacaaagccgatgatgaaaaaccagacattgatgaacgtcttgaagatacaggagcaaaagaagattccaaagtaaaaattcttgcagttacctcttgtccgaccggtattgctcatacttacatggcagcagagggacttgaaaaagcagcaagagccaaaggatgctttattaaagtagaaaccagagggtccggtggagcaaaaaacgtgctgacagcagcagaaattgaagaagcagactgcattatcgttgctgccgatgcacaagttccgatggatcgtttcgatggaaagaaattaattgaatgtcaggtatctgacggaatcagcaaggcagaccagctcgttgaacgtgcgatggcaggagatgcaccgatttatcaggcaaagggtgcagtacaaaaatccagtcagtcaaagggaagcggaggggttggacatcagatttatacacagcttatgaacggtgtttcccacatgcttccattcgtagtcggtggtggtatcttaatcgcacttgcattcttaattgatggtttaagtgtagatatgaattctcttccggttgaccagagagcaaactttggtacaattactccggttgcagcgatgcttaaaggaatcggtggtacagcattcgcattcatgctgccgatacttgcaggatttatcgcaatggcaatcggtgacagaccggcacttgcagttggttttgtcggtggtatgattgcttctcagggaaaatctggtttccttggtgctttagtagcaggttttgcagcaggatacatcattgtattacttagaaaattatgtgacaaacttccacaggcaattgagaaaattgcaccggttctgatttatccggtagtcggaattctagttatgggattattaatgaacttcgcagtagaaccgattatgggtgcaatcaatactgcattaaataacggtttgacaagcatgggcggttctagtaagattattttaggatttatcttaggtggtatgatggcgattgatatgggtggtccatttaataaagcttcttatgtatttggcactgcagcaattgcttccggtaactacgatgtcatggcagcagttatgattggaggtatgactcctccatgtgcaatcgcacttgcaactttattatttaaaaacaaatttacaaaagaagaaagagatgcaggtcctacaaactttatcatgggactggcatttatcacagaaggtgcaattccatttgcagcatctgacccgcttcatgtacttccggcatgtgttatcggttccggaatcgcaggttctttaagtatgttattcaactgcactttaatggcaccacatggtggaatctttgtattccctgtagtcggaaatccgtggatgtacctggcggcactggtagttggaacaattgtttccactgtactgcttggaattttaaagaaaaaagtagaagaataagaaaaaattaaaattaagaaaataaaaagcaagaaaataaaattaaaacaagaaaaggagaatttaccatgaaagaatttaagtacacaatcacagatccagaaggaattcacgctcgtccggcaggagaacttgtaaaagctgcaaaagagtttgcaagcacaattaaattaaacaaagacggaaaagcaggagactgcaaacgaatcttcggaattatgggactcgctgtaaaacagggaaatgaagttacctttacttttgaaggggaagatgaagatgcagcttatgaagcaatcagcgcattcgtgaaagaaaacctgtaagaaaaaagcagaacatgaaataaagccggggtcaaattagttttgacccctgtttttttaaaggaagaaaggggaagttagcgatgcagatttatagtggaaaaagtgtatttagtggaattgcaattggaaaaatctgtgtatatcagaagagcgagcagcaggtaaaacgtgtacgtacagaagacagtgaaaaagagtgggcacgttataacgaagcaaaagagaaggcattggaccagcttcgtggtttatatgaaaaagcattaaaagaagtcggtgaagcaaatgctgctatctttgaagtgcatcagatgatgcttgaggatgatgactataatgagtccattgaaaatattatccgtactcagaaagtcaatgccgaatatgcggttgcatcgacaagcgataatttttctaccatgttttcgtccatggatgacgactacatgaaagaacgtgctgcagacgtaaaagatatttctgagagaatcctttccctgcttgcaggcggagaaaaaggcaaagtagtgacggatgaaccggtaattattgtggcagatgaccttgcaccgtcagaaaccgtacagttagaaaaagataaagtgctttcttttgtaaccgtgcatggttcggttaattcgcataccgcaattcttgcaagaaccatggcaattccggctttaattggaacagagatgcctctggatgaacgtgtcgacggaaaatttgcagtagtagacggagtaaatggaaaaatctatgtagagccggatgaagagacacttgcagaattaaaagaacgccagagagaagagttagaaaagaaagaactgctcttacagctcaaaggaaaagaaaatattacacttgatggaaagaaaatcatgctgtatgctaatattggaaacataaaagatttagcaactgtcgtacagaatgatgcaggtggaatcggacttttcagaagtgaatttatttatctggaaaaagaagattatccgactgaagaagaacagtttaagatttataagactgcagttgagacaatggcaggaaaacgtgtgattatccgtacgttagatatcggcgcggataaacagtgtgattatttcaaaatggaaaaggaagaaaatccggcactgggatatcgtgcaatccgtatctgcctgacccagaccgaaattttcaagacacagcttcgtgcgctgtttcgtgcaagtgcttatggaaatcttgcgattatgtacccgatgattacaagtctttgggaagtaaaacgaattaaagaaatcgtagaagaagtaaaagcagaactaacagcagaagaaattgaatttggaaatccacagcagggaattatgattgagacaccagcagccgttatggtgagcggggagcttgcaaaagaagtcgatttctttagtattggaacaaacgatttaacacagtatacacttgcaattgaccgtcagaatccgaaattggatctgttttataatgcacatcatccagctgtgctttctatgattaagatgactgtggaaaatgcacacaaagcaggaatctgggcaggaatctgtggagaacttggagcagatacctctttgacaaaagattttctggctatgggtgtagatgaactgtctgtatcaccgggaagcatccttccgattcgaaaaatcattcttgagacaaatgttgaagaatataagagaggaaattatgctgacggagaaacgttatgaagtaatactgaaatgtctgaatgagaaaaacagtattaccgttacagaattaaaagagttacttggaatttcagaatcaacaataagaagggatttaactgcactggataaagccggaaaactggtaaaagtatttgggggagcagttgcagtggattccggatttacaaccgttgagccctctgtggctcagaaatcaggtgtaaataaagaagaaaaaagccggattgcgcagtatgcagcatctttgatttcaccaaatgagtttgtttacttagatgccggaacaacaaccggacgaatgattgaatacatcacagaaaagagcgcagtgtttgtgaccaatgctgtcagtcatgcacagcgtctggcagcagagggattcaaagttcatctgattggcggagaattaaaagggacaaccgaagctgtggtaggaaatcaggcaatcttaaatattcagagactgcatttttcaaaagccttttttggtgtaaatggaatcagcttaagggcagggttcagcactccggattacagtgaagcaatggtaaaacagaccgcactgcatcaggcgagaattgcttatgtgcttgcagattactcaaaatttggaaatgtcagttccgtgacctttgcaaatttagaagaagcggatgtgttgactgacagaaaaccaccggaaagcttttccggatgtaaaaatattctggttgtgtaaatttacgttgtttttacaacccaaatcagttattatattaagtagaagaattaattaagaaaaagatttgggggtggtaaaaaatggagcgttatgatgtatttcatgatattcttgtgaatttatttcaggagattatggatatcgaagagaaagccctgattaccgctgaatttaaaaatatatccgtgaatgatatgcatatcattgaggcaattggaacaggagaaccgaaaaatatgtcaactgtggcaaagctgatgtccgtcacggttggaacacttacaattgcgattaataatctggtaaaaaaaggttatgtaagcagagtcagaagtgaagaggacagaagagtcgtgttgattttcctgactgaaaaaggaaaacgggcgtatcagcatcatcgggagtttcatgatggaatggtaaaagcactggtggaaggtctggatgaagggcagcagaagattcttgtgaaatctttactgaatttgagaacgttttttgattcttataaaaaagattgagtgtacagaaattttgtacacccaatctttttttgctttttaatagttttccagtacatacttttctataaccggaaacggagcaggtccggtttctaatacaaatcggtgaaattcttttttatcaaatttatcaccggcttttttttcagccaagtctcttaaatccataaaattcagatatcccagatagtattttaaataattggcaggattttcaatgatgtattggtaaatttccttgcaggtatcatcagaagcaatgccgaatccatgcaaagactgtgtaacctgagctaaggtccagccgtattcatggattttaatatcgagtagagaatacaggcagagactgatggagcggttttgccataaaagctgtaaaagttctggttcgactttaaaataggaggcggcatagccgtaggaaatggattcgacataagtcgcccagccttcaatatagccactgcatccgagcagatttcggataggagcaggattttgatttccataatataaagtttgatagaggtgtcccggaaagccttcatgggcaagtgtggtaaagagttcggcaggatttacctgtgaacttcgattgatataaatggtatttggacttaaggtgtccgcaggcggagtcagataaaaggcgggactggaaaattcttccattgaggtgggaacatatttcacttcgtacttgggactgtctaaatcaggaaaatccgtctgcatggctttgtttagataggaaagcatttcttctggtgtggcagaaagagaaaaaacagaaagattttgtgcaagggatggattttgggagagcagagtctgcatctggcggtaatcaagggcaagctgggtaaaaagccgttcttcgatttcgttggtactgcgaaaatctccgacctgactttgaatcaggtagtgataataggcagtaccatctggaaaaccggcaagccctctgtcatttttttcactgccttttagagcagaaagcttttctgaaagtgattgataggaaggaatcacgcaggtatggattaatttttcatggaggcttagataggaatctgcctgttttttggtaagtgtatcagtattttgaagtgaattaatcttatctttaaaagcagaagcaagataatccgaggagagcatggtctgacactgtgtaagcaggcgctccaaagaagcatcactcataaagagcccacgcttcgctttttgagattcaaattctgccagttcgttataatagtcggggaggcaggagagtagagaaaaatagtctttgatatcgtttcctgtgcggaaggtgtattcggcaagcagaatcggaagctgggaagaaattccgagatgaggacttaagggttcttgaagccagaaaaagttttcaccggaaagctgcgtggaaaattccagagagagaatatcataagtcagctggttttctttggaaagtttttgatagtgaaagtttttcaggcgtttttgattggattttaatttagaaaatgaattagaatgagctttttcgttcattgagccaagactgattttataatccttgattccaaatttctcgggatgtgcaagcgtataatgcagatttaaagtattagaagaaagttcggaagtaaaaatagaatcggtaaagtgttcaaactgtttgttttccagagtgggttcgatttttttcaaaaagatgatagaaaaaacaagaaagaagcaaaaaatgaaaatcaagattcgatatttgttatgtaggaaatttttcaaagaactgtcctcttaaagcttgagaattctttattagtttatgaaaaaaatgaaagagtatgaatgcagataagcattcccccgcttcaagtgcgcagatcgcgaagcgactgcgttcatgagcaagtagcgaagcggattgcgaatgtctgctttaccaatacagacaaattggaaaaagcctctgctggaaaaaggcagagacttgtgataagctaatgaagaagtgaactctaaaataagggaggaaatgcaaggtgaaaaagaagatgctggttttatttctggcagtgggaatgatacttggaggatgccagaacacacaggaaaaaccacagaccggaaagggagaagaaacatcacgggacgaaacggaagacacgccagaagaagagaagaattatgatgtaaaactgtcgaagaacttatatgattttgaatttgcaataaatgatacggtttttcatttgccgcaaacgctggatgagtggaaggagactggatggtcttatgagcgtgccgagtcggaagaaatgctggatggtgattcgtttttggagggggagacattaaagaacgaggaaaaagaactgattgtggatattgtgaatctggatggagaaaaacagcagcttggcgcatgcagtgttgggggagcgacactggaaaatacggataaggataatatggtttatcaactgcctggaaaaatcacagtgggagaatccacgttagatgatgttttagatgcgtatggagacccggatgaccggtatgaggaaaaagactgggtttatgtaacctatgaatatggaatttataagaaagcggatttggtatttgacattgaagatgaagtccttgaaaaagcagtgctgaaaaattacagggattctgaaccggaagaaaccagcaaagacgtgccaaaagaagtgagtgactatcaggctccggaagctttttcagagaatccactggattttatcgtgcagtttgatggagatttttatcagcttccggcaccggtttctgaatttatcaaaaacggatggaaaatcgatgaagaaggttccgatacctcggtaaaggcaggacgccatggctatgtaacattggaaaaagacggacagacgttatatggtgttgtgaataattactctaagagtgcagttccgattaaaaatagttttcttaccaatctgcatggagattttgatgtgacaaaagtgccgattcagatttatagagggattacgcttggaatgaatgaagaaagtatgaaagaagcgttatcggatgcaaaatatgaaacaaaagaggacgaagaaggagtttcttattatctttatgcagatgaagaaaaacgggattatgtgcggatttttgtagataaaaatttaaaattggtgcgtgaaattgagctgagtaacagtccggaaggactggaagagaaaatgttatcggaagaggatgaaaaaagtgtagaggcttctgcaatgtcaggcagtgatactcttccggaacaggaataaatttaagaaagaagagataacaggtatggaagaaaaaatttatgatatggtaattatcggagcaggtccggcaggaatgagtgcggcggtttatgcaaagcgtgcagagctttctgtgctggtgattgagagagattttgcaagcggtggacagattgtaaaaacctatgaggtggataactatctggggctgccgggaatcggcggatatgagctgggtgaaaaattccgggaacacgtagataaatttgaagttccgtttgtaagagataaagtacaggaaattcagttagatggaaagcttaaaaaagtaatcacgagaaagggaggatatcttgctaagactgtgatttttgcaggaggatcaagcccgaggctgcttgagattcctggagaagaagaatttcagggaatgggtgtttcctattgtgcaacctgtgacggtgcatttttcagagagcgggtgacagcagtaatcggaggcggagattcagcagtggaagatgtgattttcctttcacgcatttgtaaaaaagtgtacatgattcacaggagagattcgttaaaagcatccaaatctctgcagtcagtccttgataaacttgaaaatgttgagattttgtgggatactgtagcagaagcgataaagggaaacagtgaggtagaaacacttcagataaagaatcagaagactcaggaaaaacgtgagctttcggtagatggagtgtttattgcagttggagcagttccgaataccaaagaatttcagaatttgattcaactcgacgaagcaggttatatcgcagcggaggaagattgtagaaccaatgttgcgggaatttatgcagcaggagatatccggacaaaggcactgcgccaggtggtgacagcggtttcagatggcgcaaatgcagtttacagtgcgcagaaatatctatctgaacttgcataagggacagggaaacacataataacacatggcaaaaagaggattaaggaggaactttttgatgaaaaacacaaaagtactggtagaagaactggaacagggaaaatatgacagcgttctcttagatttatatgtggatgcggaaaaactggactatcagagaaaacgttatattgagacaatcaaaaaatatgaggaaacattcggagaaggcgaagtggaaatctatagcgctccgggaagaagtgaagtaggtggaaaccatacagaccatcaacatggaatggtacttgcaacttctatcaatctggatgcactcgcagtagtgggagcttcaaaagacgaaaatattcatgtaatgtctgaaggatatgacatggtggatgttgagattgatgatttagaagccagacatgaagaagaaggaacaactgctgctttaatccgtggtgtaaccgcagatttaaaaggaaagggttatgaagtaaaaggatttcaggcttacgtaaccagcgatgtattgattggtgcaggactttcatcctcagcagcttttgaagtaatcgtgggaaccattctttccggtatgtttaatgacgaaaaaattgacccggtagtgattgcacagtccggtcagtttgcagaaaatgtatactttggaaagccatgcggactgatggaccagatggcatgttcagttggtggtatgattcatattgattttaaaaatccggaagagccggtagtagaaaaagtaccatctgattttgaagcttatcagtacagcttatgtattgtagatacaaaagcatctcatgcagatttgacagatgattatgcacagattccggcagatatgaaaaaagtagcgaaattctttaaaaagaatttcttaagagaagttctggaagaagaattttataaccagatttctgcaatgcgtggtctgttaggagaccgtccggtgcttcgtgcgattcattttatggaagaagaaaccagagtacagaaagaagtggattctttaaaagcaggagacttcaaaggatttcttgaactggtaaaagaatccggtaactcttcttttaaatatcttcagaatgtatatactacaaatgacttaaatcagcaggccgtttctgttgcactcgcaggaagtgagagaattttaggaaaacatggcgtgtgcagagtacatggtggtggatttgccggaacaattcaggcattcgtagaaaatgatttcgtagaagagtataagagaagaatggacaaagtatttggacatggttcttgtcaggtattaaaagtacgtcaaaaaggcggggtaaaagttctcggataagaaatataattttcagaatattcacggaaaaaaagtgcacaaaagattttaaaaagtggtcaaaatcacgaaaaatacggaaaaagttatccacattttattgtggataaaaggctgtaaaatcaagttatccacaaagttatccacattcgtgtggaaaatgtggataacttttttgatttacataagattcgagccaaacagacgttttgtgcataagttataaaagtggatttgtggataactttgtggacaaaaaaatcacgagagtcaaattcaattattggggaataaacacttaaattgtatgaaattatgagaaaactaaatataatatcagaaaataatgaaatcctataaaacttcataaaggacacaaaaaaacaccgtccccgcagtatcaagtctctgcaaaaacagtgcttttagtgcgccttcagggactcgaaccctggacaaatagattaagagtctactgctctaccaactgagctaaaagcgcattcgttattccatttctttaatgcaaaacttattatactggaataaacgaaaaaatgcaaggggaatttattgtattttttgtttttatttaaaaacatgatgccaaggtcaaaaagttcaaaaatcgttcgggcttgcacgacaagatttttgactttggggtcgcctaaacatgaaaatgtagcgatttacgtagtaaatcagcggaatttgaatgtttatagaattgcgagagctgttttacagcgaagcaattcgtaggcatcaattagagttttttagcgttttttcttcaaatattgcagcgatttctcggcttccatggcggccttcataattcgtgccgcctgtgttcccatttttcgattggtgtaagcccagatagagagtgtggtctgtaaagatttcttttttgacaaagcaaagattcctttttatttaagtatatgaaaagaaatcttatcttgctgcaattaatttacagattggatttccctcagaagagaatttttcttcgtattcggtcataatattaccgacattcattttttcgttgtgatggaggtcgtaagtccattcgaccagatgccatttgctttcattgacttcctctaaagagaaatcaaagagcgggcgattgtcggtcttaaattcaatgactccgtctgattttaagattgcatcatagcgttctaaaaactgacgtgaagtaagacggcgtttagcatggcgttcttttggccatgggtctgaaaagttcagataaattttatcgacttcccctgcgtcaaaaatgagtggaagttctcttgcgtccatgcggacaaagtaaacatttggaagagtgtttccattttcggcacgttcttctattttttgaagagcacgtagaagaacactgtcgtacatttcaaatccgatatagttgatatccggattctgggaagcaagatccattaaaaaacgtccctttcccattccaacttcaatgtgaattggatgattgtttttaaagatttcattccaacgacctttattttgtgccggttcgtgaatgacataaggactgctttcgatggcatcttttgctcctggaatatttcttaaacgcatatttcgttccagcctttctatttatgtgattgatatctgatacagtatactgaatctgaaattgtttgtcaaagcctactcgtcaaaacggaagaaagatgtgggaaaatagacagaaaaggcaggaaaggtttagaaaaattgcataatttaatagaaactttatgaaaaaatctatggattttttctgaaaatagtgtatgataggagacaagtagtagaatatagttaaaaaatagtttaacttaagatttcacttaaaacaaggaggagcttgcatggatgatgtaattagtaagctggcagaaatagaattggctgcctccaaaataatggaaaatgtggtggaggagaaaaaaagcctttctttagaaaatgaagccaggataaaagcctttgatgatgaggtggacaaaaagacagaagaaaaattggaggggatacgaaaagggcttgaagtggatatggagcaggaactgcttttacagaaacagcagacggaggcaaccttaaaaaaaatggaagccggatacgaacagcgtgccgaggcaatggtgcaggagttatacgacaaaatattaaggatgtgatattatgggaactctgttatcttacagtggtctttcaacaaaaatccgagcgatgcagagccggctgatgacagaaaaacaatatcaggaaatcgcacagatggaatccgtgacacaggtagttgcatatttaaaaagacagcctggatttgcaaagctgtgggcggatctcgatgaaagcagtctgcatcgtggagagattgaaaaacttctgacccataccatccatcaaaattttgcgaagatttaccggttcgcaaatccatcgcagagaacctttatggatttgtattttaaacgatatgaaattgcggttatgaaggactgtctgagaaaaatctttgatggaagtggagatggacttgatttatcactgtttcaggatttctttgataaacattccaaattaaatttagagaaactgaccaaatcagcgacggttgaagaatttgtttctaatttaaaaggaacagagtattatgcaccgctttcaaggattggacaggagtatcatccattgttgtttgattatggaatggcgcttgaccagtattattttgcaaatatctggagaatgaaagataaactgtttaagaagagagatttagaagagattataaaggcttatggtaataaatttgatatgttaaatctgcagtggatttatcgttccaagaaatattaccacatggcaccggcagatatttatgcgttgctcagtccggtgcgttacaaactttcaacaaaagaaattacagaacttgtagaagctgtggatgaggaggagtttcgcagggtacttgatactacggcatataaaaagcattatccggaactgacacctgataagctggaagaatattataatttcagcatgaggacgattttagagacggaagcaagaaagtatccacattctgtaatcatgatatattcctacttttatcataaggagcatgaggtggatcggctgacaacagcaatcgagtgtatccgctatggtttggctccggctgagacattggaatatattcatagaaattaaaccggaggtagcagacatgattgagaaaatgaagttcttaagcattactggtccgaaggctgatattgaccgagtggttaaccaatatctggcaaaatatgagattcatctggaaaatgcaatggcacagctgaatcaggtacaaaacctgtctccttttatacagattaatccgtataaagaggtgcttgcaaaagcagaagaatttacgggacttcttggagaggaaaaacagctgaaattacgagatatctctttagaagaagccacggaattgattgacagacttggaagtgagctgtcggaaattaatgtaaagtgtgaagaagaaaacaaaaaacgaacgaaaatagtagaagatttaaatctggtcagtccgtttttaaaacttccaggcgatattgaccagctggtgcattatcgttttgtgcaggtgaggtttggaagaattgccagagaatactatgaaaagtttaaggcttatgtatatgatagtctggacacttggttttatccgtgccacgaagatgagtatgtgtggggtgtttattttgtgccgtggaccaggatggaagaagtcgatgcagttttttcttctctgcattttgaacgaatttatttaaagaaagattattactatggaactccacaggaaatctacgataagttaagggtagagttaaatgcagtagataagaaaattgcagaatataagagccaggcttctgaattgttgaaaaaagatgcagtatctgttttttctgcaaaagagaaattaagtgcactgtcggttaactttgatgtacgtaaagtggcggcctgcgtaaaagagcatcacgaaacgttttatattttatgcggatggatggcggaagaagattctatcgcatttgcaaaagaaattgaaaatgatgcaaatctgttttgtattattgaagatgataagtataacatcaatgttcaaccgcctacaaaactgaaaaatccgaagatatttaagccatttgaaatgtatattaagatgtatggacttcccgcctacaacgagatggacccaacaatctttgtggcaattacctattcctttatttttggggcgatgttcggagatgtcggacagggattattattagcaatcggtggactcatcctttataaagttaaaaacatggatttggcagcgattatcggctgtgcaggtgtgttctctacgatatttggttttatgtatggaagtttttttggatttgaggatttaatccccgccttgtggctgaaaccatcggaggcaatgctgttgataccgggtcttggaaatatgaatacggtattcgtagttgcaattgtatttggtatgttcctgattctgcttacgatgatatttaacattatcaatgcagtaagaagtcgagatatcgaaaatataattttcagccagaatgcaatctgtggattggtattttatggcgcattgaccgttacgattttactttatatcacaggacatgcacttccggcaacagtagtattagttgtaatgtttgtaattcctctgattttaattatgttaaaagagccgttgacccgtattgtggaaaagaaaacaccggcaattgagggcggaaaagcaatgtattttgttcaaagtttctttgagttgtttgaggtaatgttaagttatctctcgaatacactttctttcgtgcgtgtgggggcatttgcagtcagccatgccgcaatgatgggagttgtattgatgcttgcgggagcagagagcggaggcagtatcaactggctgattattattcttggaaatgcatttgtatgtgctatggaaggtctgattgtaggaattcaggttcttcgtctggaatattatgaaatgttcagccgcttttataagggcagtggacgtgaatttaagccatttttaaaaaatgtaaaaacaaatcattaagtaaaaacaaatcattaagtaaaaacagaagcgagagcaaggaggacttttattatgacaggtattattcaaattacaattgcagcagcattaattttaagcattattcttccatttggagcattttttcttggagagaaaaacagaaaacgttataaaacatctcttggggtgaattgtttctttttctttggaaccttacttgtggcaactgttgttatgcttggcggaacagtgacagcaaacgcagcatctgacgcagcagcatctggtcttgcaaccggtcttggctacatcggtgcagcactcgttaccggtctttccggtatcggttccggtattgcggtagcaagttcagcaagtgcagcacttggagcaatcagcgaagatggttctttatttggtaaatctatgattttcgtagccatggcagaaggtattgcactttatggtctgattatttctttcatgattttaggacgtcttggttaaattggactaaaaacagcggcaggatagaatgggaaaggagcgggcatttatgaaaatgtttttaatcagtgataatattgacacctacaccggtatgagactggcaggagtagagggtgttgtggtacatgagcgggaggaacttagaagggcactggaagatgctatcgcaaataaggaaaatggcattattcttctgactgagaagtttggccgtgaatttccggaaatcattgatgatgtgcgtctgaaccatcgcctgccgcttcttgttgagattccggacagacatggtaccggaagagcagaagattttattttatcttatgtaaatgaagcaatcggtctaaaattataaatgattcagaaataagaaggtgatggacatgacaacggaagaaaaactgcagcatttttatgatgtatcgatggagagtgccagggaagaagcacagaaggcacttgaagaatatagaagggcacttgatgatatgtttgaagaacataaaaaagaaaaagaaaaaagtgccgagcttcgtctgaaactggaaacggaaaatgcaaagcgtgaaattaataaagcattatctgcagagcagcttcacattaaacgaaaactgtcaaagaaacagcaggagttaagagaaaaaatttttattgatctgcaggcaaagctggaaatttttcgtaagagcagtgattatccaaagtggcttgaggaaaagataaaagaagcacaaaacattgcagattcagatgagattcagatttatttatcaaaaatagatgaaaatttaaaagaaagtatagaggcagaaacagggatttccattcaactttcagaagaaccgtttatgggaggaatgagagcagtgattcctgcgaagaatatactgattgaccagacatttttaacaatgtttgaaagtgaaaaagaagaatttaattttgacggagggctgctaaatgagtagaacaggaatcatatatggaattaatggccccgtcatttacctgaaaggaaataccggatttaagatgtccgaaatggtttatgtgggagaagaacatctggtaggagaggtcattgcgctgacaaaagatacaacgactgttcaggtctttgaggagacaagtggattaaaacccggagaaacggtaactgcaaccggagatgctatttcagtcacattaggacctggaattttagacaatatttttgatggtattcagcgtccgctttctgttattgcagaacagtccggaaaatatatttccagagggatgcaggttgattcgctggatacagagaaaaaatggaatgtaaaatttctggtaaaagagggtgatgaagtccacggaggaaccatttttgcacagacacaggaaacggcttcgattatgcataagtccatggtacctccgaaagtagaaggaaagattaagaaaattcttccaaatggggaatatagtgtaagcgaaatccttgcggtagtggaacaaacagacggaagtgaatatccattgaagcttgcccagaaatggccgattcgtattccgagaccgacaagcaaacgatatccggcaacggttccgcttgtcaccggacagcgaattttggatacgttgtttccgattgcaaaaggcggaacagcggcagtacctggaggatttggaacaggaaagacgatgacccagcatcagattgcaaagtggtccgatgcagacattattgtatatattggatgtggagaacgtggaaatgaaatgactcaggttttggaggatttctcaaaactgcatgacccaaaaacgggaaatgcactgatggcacgtaccaccctgattgcgaacacttcaaacatgccggttgcagcacgtgaagcttctatttataccggaatcacgcttgctgaatattaccgtgatatgggatacgatgtggcaatcatggcggattccacttcaagatgggcagaggcacttcgagagctgtccggacgactggaagaaatgccggcagaggaggggttccctgcttatctggcatcaagactgtctgcattctatgaaagagccggcatgatgcagaacttaaatggaacagaaggttcggtatcaattatcggagcggtttctcctcagggcggtgacttctctgaaccggttacacaaaatacaaaacgatttgtgcgctgtttctggggattggataaatcccttgcttatgcaagacactttccggcaatccactggctgaccagttacagtgagtatttaaatgatttggcacactggtatggagaacatgtttcacccaaatttgtggatgacagaaataaattaatggcaattttgaatcaggaaagcagtctgatggaaattgtaaaattgattggtagtgatgtacttccggacgaccagaagctgacccttgagattgcaagagtgattcgtcttggatttttacagcagaatgcatttcatccggatgatacctgtgtttctctggagaagcagtttaagatgatggaaattattttgtatttaaatcaaaaatgcagaagtctgattgcaatggggatgccgatgtctgtacttcgtcgggaaaacatttttgaaaaagtaatctctattaaatatgatgtaccaaacgataagttagagatgatggatgattatcaaaaagcagtagatgatttctatgatacagtcatggaaaagaatggataaggagggaacggaatggcaatcgaatatcttggcttaagtgaaatcaacggccctctggttgtgctcgaaggggtgcaggatgcagcctttgatgaaattgtagaatttaaagtagatgacggtacaaaaaaaatcgggcgtattgtagaaatttatgaggataaagctgtcattcaggtatttgaaggaacagaaaacatgtctctgttaaacacccatacaaaattgaccggacatccgatggaagtagaattatctccggacatccttgggcgaacctttaacggaatcggaaaaccaattgacgatcttggcccggtgattccggaaatgaaattaaatattaatggtctgccgttaaatccggtcaaacgagagtatccgagaaacttcattcagacaggtatctctgcgattgatggtttgacaaccctgattcgtggacagaaacttccgattttctcaggaaacggacttccacatgatcagcttgcagcacagattgtaaaacaggcttctcttggtggggacagtgatgagaaatttgcaattgtatttgcggcaatgggcgtaaaatatgatgtagcagaatttttccgcagaacttttgaggagagcggtgttgcggaccacgtagtcatgtatctgaatctggcaaatgacccagtagtagagcgattgattacaccaaaggttgcacttactgcggcagagtatctggcatttgagaaaggcatgcacattctggtcattcttactgatattacttcttttgcggaagcgatgcgagaggtttcttcttcaaaaggagagattccatcaagaaaaggttatccgggttatttgtacagtgaactggcaaccctttatgaacgtgcaggaattgtaagaggtggaacaggttcggttacacagattccgattcttacaatgccaaatgatgatattacgcatccaatccctgacttaaccgggtatattacagaaggtcagattgtactcgagcgtcagcttcatgggcaggcaatttatccgccgattaatgtccttccatccctgtctcgtctgatgaaggatggtatcggtgaaggttatacgagagaagaccatcaggatgtagcaaaccagctgttttcctgttatgcaaaagtaggagatgccagagcacttgcatctgttattggtgaagatgaactttcaccgctcgataaaaaatatctggaatttggaaatgcatttgaacaacagtttgtcggtcagggaccggatgaaaacagaagtattcaggaaaccctggatctcggatggaaactgcttggaatgattccaagagatgagctcgaccgtattgacacgaagatactggataaatactatcatccggaagagaatgcataaagaagaggtgatgttatggatccgaatacctttccaaccaaaggaaatctgatactggcaaaaaattctctcgctttatccaaacagggctttgatttgatggacaaaaaaagaaatattttaattaaagaactgatggagttagtagaccaggcaaaagatatccagtcacagattgatgtcacatttcgtacggcttattcggcacttcagagagcaaatttggatattggaatcagctatgtacaggaaatttcaagaactgttccggtggaagattcgattcagattaagacccgaagtgttatgggaacagagattccattagttcaggcgaatgagtcatccaatgcgccaacttatgcttattatggaacaaaggcttctcttgatgaagcaaagtcagcgtttgaaaaagtaaaacagctgacgattcgtctttctgcggtggaaaatgcagcctatcgtctggcaattaatattaagaaaacccagaaaagagccaatgcgctgaagaatatcacaattccgaaatatgaagaattgacaaaatccatcagcaatgcactcgaagaaaaagagagagaagaatttacaaggttaaaagtaattaaacgaatgcagggaaaataaaaaacataatttttatagaagagaagttgttaaaagaggaattttaacaacttctttttttaccaaaatttaacatgagacagattttatattttactttgcttttttatactgagactcgtaaatgagagcaatactaaaaaagataaaaattataaagcaaggagaatttaattatgaagaaaaaattagcagcattattaattacaggaattatggcagcagcaatgacagcatgtggaagcagtaattcaggaacagacaacagtggaagtacagatggaactgcaaaaacagagagcagtgccgatgcgggcagtgactgggataatacaagagacatcacagttgtatcaagagaagatggttctggtacaagaggggctttcgtagaattattcggaattgaagaagaagtaaacggagaaaaagtagatatgacaacagaagaagcaaatatcacaaacagtacttctgttatgatgtctaccgtggcacaggatgaatacgcaattggttatatctcgctcggttctttagatgattccgtaaaagcagttaaagttgatggaagcgaagcaacagcagaaaacatcaaaaatggaagttataaaatttccagaccgtttaacattgcaacaaaagaggatttaagtgacgcagcacaggattttgaagactttattttaagtacagaaggacagaaagtagtggaagacaacaaatacatccctcttgatgatgtgagtgattataaatcaaatggagcaagcggaaaagttgttgttgcaggttcttcttctgtatctcctgtaatggaaaaattaaaagaagcttatcaggcagttaacagtgatgtagaagtagaaatccagacaagtgattctacaacaggtatgcagaatgcaattgatggtgtatgtgatatcggaatggcttccagagaattaaaagattctgaaaaagaagcaggtctgacaccaactgttattgcaatggatggtattgcagtagtcgtaaacaatgataacccgactgatgaactgagttctgatcaggtaaaatccatctttacaggtgatgtgcttacatgggatgaggcgcttcagtaaagaagacttaagaaagaatcagtagcctgaagaaggttaaaagggtgaacagaatgaaaaaatataaagaacaggtgatgcatgcggtgttttttatcgccgcatgtgcatccgtacttgcagtcgctttgatttgtctgtttttgtttgtaaacggaattccggcgatgaaagaaattggaattttcaagtttcttttaggaacgatgtggaaaccgggaaataatatttacggaatccttccgatgattatgggaagtatttatgtaaccgcaggtgcaattttaatcggagttccgattggaattttaacttctgtatttatggcttcctactgtccaaaaaaagtatatcgtttttttaaatcggcaattgacttattggccggaatcccatcggttgtatatggtttctttggtttaatgatgttagttccactgattcgcaatttattccacaaaggaaacggaagcagtattttaagtgcttctatcctgcttggaatcatgattcttccgacgattatcggggtgacggaatctgcaatccgtgcagtaccttccaattactatgaaggttctctggcacttggcgcaacaaaagaaagaagtctgtttttcgttgtgcttccggctgccaaatccggtctgattgcaggtgtggtacttggaatcggtcgtgcaatcggtgaaactatggcagttgtaatggtagcaggaaatcaggcacgtatgcctgccggaatcttaagaggtgtccgaaccatgacatcaaacattgtactggaaatgggatatgcagcagatttacacagagaagcattaatcgcaacaggcgtggtattatttgtatttatcttaattattaacttctgcgttgccagattaaataagggggaaagtggtcatgcataaaaaagaacatcagggagcgaaaatcagtgccggtattttaaaaggtctggtctttgcatcagccgctttaacctttttagtcttatttttcctgattgtctatattttggttcatggaattccgaatctgacaccacagttatttgcatggaaatatacaagtgaaaatgcttccatgcttccatctatcattaatacgttaattattgtgatattatcactggtcattgcagtgccgcttggtattttttccgcaatctaccttgtggaatatgcaaaaagaggaaataaatttgtaaaaattattcgtctgacgacagagacactttccggaattccatctatcgtatatggtctgttcggtgcattgttttttgtaaccgcattaaaatggggttattctttacttgcaggtgctctgacattgtcaattatgattcttccgctgattatgagaacgacggaagaagcattaaaatccgttccggattcctttcgtgaaggaagtttcggacttggagcaggaaaactcagaacggtatttcaaattgtacttccaagtgcaattcccggtattttagccggtgttattcttgcagtcggacgaatcattggagaaacagcagctttgatttataccgcaggtgcggtggcagaagtgccgtcgagcatcatgggttctggttcaactttagcagtacacatgtacaatctttccagagaaggtttatatatgaatcaggcgtatgcagtatccgttgtcctgttaatttttgttctgctgattaactggggttccggaaaaatagcaaagaaacttacgaaagggaaagaataacggaaatggaattgaaaaaaaatcagaaaatagaagtctcaaatctggatttgtattattcagattttaaggcattaaaaaatataaatattaagattccgcaaaatgaaattacagcatttatcggaccgtccggatgtggaaaatcgacgcttttgaaatcattaaatcgtatgaatgatttggtagaaggatgccggattgatggacaggttttgctggatggagaagatatttacggaaggatggatgtcaatctgcttagaaaacgtgtcggaatggtatttcagaagccaaatccatttccaatgagtatttacgataacattgcttatggaccgcgcactcatggaatccgttccaaatccaaactggatgatatcgtagaaaaatccctgcgtgatgctgccatctgggaagagacaaagaatcgtttaaaatccaatgcacttggaatgtccggtggacaacagcagagactttgcattgcaagagcacttgcagttcagccggaagtacttttaatggacgagccgaccagtgcccttgatccaatttcaacttccaaaatcgaagaactggcaatggaattaaagaaagagtatacaattgtaatggttacgcataacatgcagcaggcagcccgtatttctgataaaactgcatttttccttttaggggaaatcgtagaatttggtgaaacagaacaattattctctatgccgaaagataagagaacagaggattatattacagggaggtttggttgatatgcgtacaagatttgaccagcaattggaaaaactgcatgtggaattaattaaaatgggaagtttatgcgagcaggcaatcacactggctgcgtcttctttagaagttcaggaagagaatactttgcataaagtggcagcacttgagagtgaagtagatgcaaaagaaagagaaattgaagatatctgtatgagacttctgcttcagcaacagccggtagcaagagatttacgtgttatctcggctgccttaaaactgatttctgatttggaaagaatcggcgaccaggcggcagatatttctgacttgactccttatattgtaaacagcagtattgcgagtaaagttcagattcatgatatggcaaaggcaacgattgacatggtaacaaaaagcattgatgcgtttgtaaaaaatgatttggagcttgcagaaaaagttattgaatcagatgatatcgtagatgatttatttaataaaataagagaagaactgattcaggaaattcagggaaaaaacaatgacccaagagcggcaattgatattttaatggcagcaaaatattttgagagaattggcgaccacgcagttaatgttgcagaatgggtacagtattctattaccggtgtgcataagagtaatgaacatcatatagcagacagataggaatgaggtgaaagggttggtctatctggtagaggatgatgaaaatataagagaactggtcacatacacattaaacagtcaggggattgaaacagaaagctttgaacgcccatctaaattttggaaggcaatgcagcaggagattccatccctgtttttgcttgatattatgctgccggaagaggatggacttagtattttgaagaaaattaaaaatacaagccagaccaaaaaattgcctgttattatgctgactgcaaagggaagcgaatatgatacagtattaggtctcgacagtggagcggatgattatatcgcaaagccgtttcgtatgatggaactgatttcacgagtgcgtgctgcattaaggcgaagcgatccggaggaacaggaaagggtcaaagaatatcagtttggaaaaatctatgtttgtccatccagacatattgtgagtgtggacggaaaagaaatttcacttactttaaaagaatttgaactgctgtgcgtactgctttctgaacaggaaactgtattttcaaggtcaaaattgttagaccgtatctggggctatgaatttgatggggaaagcagaacggtagatgttcatgtgcggacactcaggcaaaagctgggagatgccggagactgtattaaaacagtaagaggagtaggatataagataggaggaaaagcttcatgacaaaacggattttccgctcaattatgctggtttctgcagtctgcatggtgacaggactggcatttcttatgggcgttttatatcatttttttgggaatcaattagaaaaagaattaaaagcagaagcatcttatctggaacttgcagtagaggaaaatggagagagtgtacttgagaagcttccaaaaaattcggcaagggtgacctggattgcggaggatggaacggttatttttgataataaagcagacgcttttgatatgtcgaatcacaatgacagggaagaaattaaggatgcacagaaaaacggtgcaggaacttctgtcagacagtctgatacattaggagaaaagacggtctactatgcaaaacgtttgtctgataatagtatccttcgtatttcgagcgatcagtatacggtgattgctctgttaaaacagctgattctcccagctgtctgcgtgctggttcttatgatattattaggagcattttttgcatcgagactttccaaacatatcgtaacaccattaaatgagctggatttggaacatccggatgaaattgatacttatgatgaaatggctccatttattacaaagattaataaacagcagaagaccattcagaaacagctttcggatgcaaaacgacagcagaaagaatttcagattatcacaaagcagatgcaggagggacttcttgtcatcgatacacagacagatttgctttccagtaatgccagtgcactggaacttttagatgccggacaggtaaaagataaagaaagtgtgctgtcactgaatcgtagtgaagcatttgagaagacaatagacaaagtcttacgtggagaacatgtagagtccgtattaaatttgggagaacgttactgccaggtttgtgcaaatccggtatttgacaaagaaacgatagcaggtgcagtgattcttttaattgatgtgactgaaaaaatgcagagagattctttaagacgggaatttacagcaaatgtctctcatgaattaaagactccgttgacttcgatttcaggctttgcagaaatcattcaaagtggttttgtaaaacaggaagatgttcggaagtttgcaggaaagatatttgatgagacacagagactggttaccttagtggatgatattataaaaatttctcagctggatgaaaattgtcagccgtatcagagagagaaagtagatatctataatctggctaaagatgtattgagcaggcttcaggaatctgctaataaagcacaggttcagttgaatatggaaggtgaacatgcagaacttgaaaccgtactgccgattttagatgaaattgtttctaatctgtgtgataatgcgattaaatacaataaaaaaggcggaagtgttaccgttacggtattaaatacaagaaatcagatatgcctgtctgtctgtgataccggaattggaatcacagcggcggaaaagagcagagtatttgaacgattttatcgtgtggataaaagtcattcaaaagaaattggtggaaccggtcttggactttcgattgtaaaacacggtgctgcttatctgggagcaaaagtagaactggaaagtaccattaataagggaagtacattccgtctgatttggcaaaaataaaagaaaaagaccttttgaacattgttcagaggtcttttttgaattgaaaattagtattttgaattttattttgaattagaaattactgcatcatacctgcaagtacctgatttaccagtttgccatctgcaattccttttacttttggcatcaggactttcatgatgcgtcctttatcttttccggttggtgtttcaatttcaagttcttttaaaactccatcgattactgttttgatttcgtcttcatttaacatttttggtgcaaattcttcgtatacggcgatgcgtttgctgcattcttcgataatatcagttctgtcagcaggagtcatttctaaggtttcttttgtctgtttgatttcttttaagacaacttcattttcttctgcttctgttaaatcttctcttttatcaattgctttgtttttcagtgcggataagagcatggacagagagtcttttctttctttgtcttttgctttcatcgcagctaccattgcttttcttacttcatctgctttactcatagtggttatcgctccttttcaaaatattttctaatttaagagtataacactctgaaaaaaagaatgaaacccctaattagcggattctccataaattccaatgaaaataggaagcgaggagacggatgacgacagtcacaatcaagccgataattgcaccggcggcttcaccgacagagtttcggcatatcacacaggcagcacctccggcaatggaagcgcaggcataaatttcccgaaccagaatataaggggtttcgcctgccatgatatcacgaactacaccacccccgaccccggtcaatactccgacaaaaacaaagaaaaaggcattgtctttgttcataacatttgcggcagcctgaatcccgactacagtaaagattccaagtccgagcgtatcacataaaagcatgatggtatcgtaatatttacttttaaacccagaatctaagatagaaggattggtgtagacaattgtaaacagcagggtagcagtcagcaccgaaaataacacatataccggtttggaaaatgcagcaggaggagtgacgccgagaataatatcacgcatcattccgccaccgacggcggtagtcgctcctaaaatgtttacgccaaaaatatccatttttttttcgatggcgatcattgcacctgaagatgcaaatgcaattgtgccgataatttcaagaataaaggtaaaagtatccatagatgtcctcccaacaaagacttttgtgagtgagaaaaagtctttgaaaaattgtagaataattaatattgtattagtacaacaaagcagtttcagtatagcataaagacgtaaaaaaaacatctttaaatggcacaaagtccgtgaattacggacgttaaaagatttgactttttatggattttttgttactctatttaagactataaagtgtaaaattgtgaagttggaaaggggaaaaatggagaaacataaaaatgggagctttacaagctcaattggttttgtattggcctgtgtaggttcagcagtcggtctgggaaatatctggatgtttccatatcgtcttggagagtatggcggagcagcatttttaattccgtatctgttttttattctgttgtttggatttgtcgggttatccgcagaatttgcatcaggaagaaaagtaggaacaggaacgcttggggtgtacgcttattgttttaaagaaagaaaacaggaaaaacttggaaaaattttaggctggattccgcttatgggttcacttggaattgcaatcggatattcgattattattggatgggtcttaagatatttaggtgcgtcagtaaccaataccgtgctgaaagaggattccgcagaattttttgccggagttaccgcatccatgaaaaacgttccgtggcatatgatgattgtggcgattacggttatcattttattagtaggagccgcatctcagattgaacgggcaaataaagtactgatgccgttattttttattttatttgcgggacttgcagtgcgtgtctttttcttagagggttcacatgagggataccgtttcttatttgtgccgaactggaaagcacttttaaatgtaaatacctgggttatggcgatgggacaggcatttttctcattgtcgattacaggttcaggaatgattgtgtatggttcttatctgccaaagaatgaggatattgtaaaatcttctttacagacacttatctttgatacaattgcggcactgcttgcagcgcttgctattatgccggcggtgtttgcctttggaattgagccatccgcaggaccatctttaatgtttattactttgccaaatgtatttaaacagatgccgatgggaagactattctcagttctcttcttcttatccgtctgctttgccggaattacttctctgattaatatgtttgaggcagtaattgagagctggcaaaatcgttttaaaatcgggagaacaaaatctgttttgctttgtggcgcaattacatttttaatcgggttattattggaagaagaaaccagagttggaaactggatggattttattaccattatcattgttccgtttggtgcagtactgggtgcaatttctatttattatgtattaggttttgataaaataaaagaagaactggaacttggaagaaagaagccacttccggtaatatttaaaccggtggcaaaatatgtgtatgttccgctttctatcattatctttattttgggattaatttataaaggtattggataattttgttgacaaaaattatcaattataaagttgccctttaattttgcctatgctataataggcgcagacagcaaatgaagaaagacagctgtggatactttgaaaacgaaaaataaaatttctactaaacaaaaggagagtacgtcatggatgcaaaagaatttgctttaaaacagcacgaggaatggagcggtaaaattgaagttgtcagccgtgcaaaactggagacaccagaagacctttctgtagcttatacaccaggtgttgcagaaccgtgcctgaaaattgcagaagatgttgatttatcttataaatatacaagacgtcataacatggtagctgttgtgacagacggaagcgcagttcttggactcggaaacattggaccggaagcaggtatgcctgttatggaaggaaaatgtgttttatttaaggcatttgctgatgtggatgctttcccgttatgtgtaagaagtaacgatgtagatgaaattgtaaatactgttcgtttactggctggaagttttggtggtgtcaatctggaagatatctccgctcctcgatgctttgaaattgaaagaaaattaaaagagtgctgtgatattccgattttccatgatgaccagcatggtacagcagttgtaacagcagcagcattaattaatgcgttaaaattgacaggaaagaaattggatgaagtaaaagttgttacttcaggtgctggtgcagcaggaatcgcaatcattaaactgttagtaagccttggattaaaacgagtaatcatgtgcgacagaaaaggtgcgatttatgaaggtcgtgagggcttaaatgcagaaaaacaggaaatggcaaaaatctgcaatctggataaagaaaaaggaagtcttgaagaagtaatcaaaggcgctgatgtatttatcggtgtatctgcgccgggtgcggtaacagaagaaatggtgaaatccatggctgaaaaaccaatcctcttcccgatggcaaatccggtaccggaaattatgcctgaccttgcgaaaaaagcaggtgcagcagttgtcggaacaggaagaagtgacttcccgaaccagattaataacgtacttgctttccctggaattttccgtggcgcattagatgtcagagcaaaagacattaacgatgagatgaaagttgcagcagcttatgcaatcgcaggactggttgatgagaaagatcttgcagaagattacattattccaaatccatttgataaacgagttgcaaaagtggtatctgaagcagttgcaaaagcagcaagagatactggtgtgaatcgtatctaatgattacagaattgcacgaactgtattacagtaaggcaattcgtggtatcatttgagtgaattatcagaatgaaatacaaaagagaactttacgtggacagaggcgcataaagttctctttttatttttttagaactttgctataatgagatgtgagttgcaaaagcaggtatataataattttgatagtacatagaaatcgaagggggaaatttatgaatcaggaagaacgggcaagactggaagagagacaacgccagaaaaaaatcagagaacgtcgtcgaaaaaaacaggttaggagacaaaaaatgttgctggctggcattattatgataattgttataataacagcaggggtaaatattgtaaaaaataaccgtaagaaagcagaacaggctgctgtgacaaaagcaaagcaggaaaaactggcaaaacagaaacaagaagaattagaaaaagaaaatacactgtctatgattgcggttggcgataatctgtatcacgatgctattttagaagaaggaaaaacagattcgggagcctggaattttgattttctgtatcaaaacgtaaaaaaagaaattgaagaggcggatctttcggcagtgaatcaggaaacagtttttgtgaataatcatgatgaagttgccggatatccggagtttgcttccccgcttgaaggtggagatgcgctgataaaagctggatttaacattgtgacacaggcaagtaatcatgcttatgataaaggaaaagccggaatcttaaattctgtaacattctggcgaaccagtcatccaaatgttactctgcttggaatccataaagatcagcaggatgaggagcgcaatcgtatacaggtagtagaaaagaaaaattttaaaattgcgatgatgaattatacatttggcttaaatgaggcaacccctcttccggaggatgaaagttattcgattgatgtatttgatgaagaacaggtcgcaaaagatattgaaaccgcaaagtcggaaagtgatgttgtaattgtatttttacataccggtgtggaagatacgacggatattgatgaggatacagaaaatcgaattgattttcttgccagtcagggtgttgatattacgatttgttcccatccacatgtaatacgtgcctttggcatgaaagaaagagcagatggcggtcagatgctggtgtattattcacttggaaattttgtgtctacgcaggaagcaattccggagttgttagaaggcatggcaaaatttacattgaagaaagatttagatacaggaaaagtaacggtttctgattattcaatgcagccacttgtcatgcactatgatactggaaagacaaactgtgcagtttataaactttcggattatacagaggaacttgccaaagcacatggaattcatgaatattctgaagaggaatttacgttagaaagtattcaggagttttttgctccatttctgactccccagacatttgcgtcgggaagccagaaaaatagtgactaattaatcgtcgcagtattgttctggtgaaaatggatagagacttttataggaatccagttcatcagaagagacaggagcacgataaatcagaccggtcatttctgtggtggcaagaccgtcaaagtcatgtctggagctgaactctacattgtatttatcagaaataaaatcaggtgaatgatttttaaaattagaattcatggcaggcatcctttctgctttcattgaaatttaaagtgagttcgtttatactttagtatatgtaaagaaatgaatttgtaagcaacaaaaacgaggaaagtaaaaatggcaaaacataaggacaaagaagtaaaaacaaacgcaatgagaattttggacaaaaacaaaattttttatgaaacaattaattatgagtgcgatgaatttatcgatgggcttcataccgcagaaaagaccggtgcaccagtggaacagtcttttaaaactctggtagcgcagggaaaaagcaaagagtattatgtgctggtcattccgattgcagaagaagtagatttaaagaaagcagcaaaagtgctgggcgaaaaatcaatcgaaatgattcatgtaaaagatattacaaaagtaacaggttatgttcgtggaggatgcagtccgcttggtatgaaaaagctatatccgacgattattcaggaaagtgccgaaacctttgacatgatttatgtcagtgggggaaggattgggtctacaataaaagtaaatccgcaggaactggcaagggtagtaaatgcgaaatttgcagattttatcgtttgttaagattaatctgtgagtcatgaaagataagatctacttcgctgatttgaatcttatcgttatcacaaagctgatattcttcctgaggagaaagtggtttaccgtttataaaagttccgtttttggaatttaaatccataatgaaaaagcaggcggcatcttttcggattctggcatgcagacggctgacagttggaatagagaggcagagaccggcaagttcaggatgttttccgataagcagaaattcttccgttaagaaaacggtgaggggctgtccattttcaaaaacagtcagagaggcagatggtgtttgggcagagttgtctggttgaagcagtactgtgtcggaagaacaggcgggagattgagggtttggcatttgaggcgtagaagcttcaaaatcagaagaaaaatttgagttggaagaacttggattagaagaaaaacctgaatcagaggagaaatctaaatcagaggagaaatctgaattagaagaggagtttgaatgggaaaagaagtctgaagcaaaattaaaaattgactcagacttctttttttgatgtcttgaagtaaggaaaaagataagaagagaacctccaccaagaagaataaaaagaaggaaattgaggatggcctgagaaatagaaatcagacgatagtgcaggcagaaatagatacagacaaaaaaggcggaaagtgaaagtaaaatcccaatcagccacccgacagaagttttttcgtgcaaggtctcttcttcaaaaaaggacgtcatgacgtcttgtgaaggggaatcttcatcatagggatggagattctgtttttgaaaaacatttgagtgatagaggttttgagcatcaggttctttagattttaattttgcaagtgcggtttttaagagagcaggacaaagtggtgactcaaggctgtctttgtacagtccatagcctaaaagtacggcattgttatcttcatggttaattttaggcagaagatattcggttaaagagataaaatctttatcagacgaagctggttcaagtggaaaacagcaaaaataaaaagaagattcaaaatcctgataaatgtaatcgggagaaagaagcaggaggtcagcgtcaagcagataatcctccatgcaggtaattgtatttaaaagtgcttcaaataaagctttcaagtcgttagaattgaatttttttgtttcatatatttgagacagactttgccgtgaagtaatttcatagtaaagagaagtttctccatcaatcagacgagggatgcatggtaacagtcctttaattgaattggaaaacagcatctttgcagggtaatcggataatgcctgttgattttcattttttaaaataagatagctgtgattgagttcacgtttataagaaatatccatattttttttatctcctgaataaaaattttagagttaaagttatttcattgcgagtcggtagctgagtgtggggatatggaatatcccggtgtgattttattgggaattgctaccggaaatattgcacaatgcctgagcttttttgattttttcaataaaaagaaccggttgtatcactttagaatgggatgtgcctttgatgtgccagtttaagttaaaaattggaaaacggaattgttcttcaaaggaaacaaggacttcatggttgcttccggaaacagaataaccacctgtttcccagtggattctgagatttgcagtagagagcccgtcttgattctttctgacagactgtatgcttccaagttcagaagcttcaagagatgcatttgtacggatgctatgatgaagtgttccaattattaaaaaaagagaggcaaaaataaccagtagaaataaaccgcttaaacaggcagcttctacggtataactgccacgaagttttaactttgtcatgtcaattcctccttaaaccgattgggaaaaaaacagattcaggaacatgccggccagtaaaaatggaataaaggggatggtttcagtgcggttttttttatgaaagaagaataaaaatcctgccacgaaaaaagaaagaaaaaaagcaccggataagactccgagtaattcccagaacccaatccagatgccaagggcaagcacaatcaatccgtcggccagaccgattgcaccgtttgaaatccagcataataataacagtgcagttccgggcagaacggaaagaaaaattgcgggaagggcgggaaaaccggaagtaagagaagtctgcattttggaaaaaatcggaattgaaatccactgatactgaatacagaaataaaagattccggttataagaaaaagtaaaattttccaaagggagacgcattggtctttgaaatcttccaatcccataaaagctaaaaaaaataagacagcgattttgctttgcatagatttaatgacctccatttcgttgtgagcatcgggaacatagatgtagattttgtagttcggatttcttgataagtcttacgtgacgggtcaatccgccacaagaagaactgctgtgataacggtttccgctttgcgtaatataaaaagtgttctggttagaagaggagcggacacagcgctcacagggatggtatttttctccataaacattgcgaagagaagaaagattggattttgaagtagttgtaacagaaagagaaagataagtacaatcggaaaaggtatgatagacaccttgataatcggtcacataaaccatttcttcggaatcagaagtatccatatccgtattgttggaatcatagccagtccatgcatgaacagaagatacgatggtaacaggaattggctgaagtggaatcagagcgacagggcttttgtataaaaaagaggcttttaaggtaatccgtccattttggtaagaggacatcaaaagagagatgccatttttatgtcccaaaatctggggcagagcttcttctttcagtgcgttggaaagctgagtttttgcataagcgatgcatagggcactggaaactgcgccgacaggagaagattcagtgtcagattcgcagtaagcatacattccgagttcccggctgctttggctaagagatgcttgaatgactgactgaatccgatataaatcaagaaataaaacaaggattacaatagccaggaagaagaatggaaagacaaatgcactttctacagtcaggcttgcagagggctgaagagagtatttttcctttcgtgttgattttaaatagtttgattttaaattaagcctgtcagtgctatttacagagtagtttatcttatccataaatcctcctggaatgtatatatcctcgaagtcttttgggatttgaccgaatcaaaaaagtttctggcttttaaccaattgacttgcgaatatccacttgacttttgtgagaatacatgagtgcaaaaagggttatcggttacatatcatacccgtaagtgcgtacagcactccaggttttctgttgcggacctgtaaaaattgtttctgtctccaggctttcaatgcaggaatccatgtaaaatgaagaacgttttggaagtgttcgaatattctgttcaatcatatccatgcatcgaaatgcctgtgtctgttcagaagaagaatacaaaagaagatgcagataattttgataattaagcccggaatgggagcgaatggtatcgctttggagaagagtgaaaatttgtccaatctgtgagagatttagctgccagctttcagtcgatttaattgccggaacactgcctccaagcatgagctgtcttacatcaagcaggctttcggcataagcccatccggcaataataagtgcttctgcgattgccatgccctctggaattaaaagaagggaacataaggcagcggcggtcatagctgcttcttctcgtttttgagggtcagtataaagatacacacaattggccgcttcacgaattgcaatcagccggtggacggttgcttttaggttttcttcatcggaagcacgaccaccgattatgtattcagcttcataacttagggcatgtccgtctttttcggtgatataatttccaagtttgtccataacataagcctgcattaataatttaccggaatcgctgttctgactttgaagagtgcccatgcctttttgaagtgtgcggtgagaaagtgtatctgtaagagaaatttctttttgggaaacctgccggtctgagggcagtaccagaccaaggatgccaagttcacgcaatcgttttaagatggcgataggattattggtttccgtaaatgcgggagggtgttcttctgcttctgtgacatcaaattccatgtctggtagtccttgttctttttgttcttcctgatttttaagggtagagtccgtctgttcaaggaaatctcttaaagaagagatggcttgtgttccaagttgatttttaacagcccgggagacctgccccataaaagaacgtgcattttcatccgtagaaagcacatacccggtgattgcacaactttgaatctggcatctggtaagacttgtttcgagtgtgggcttcataaaagattccatttgccggacgataaaggaaggattaacttgactgcctccgtagccggcatcaagatagaataaatcataagaatctaataaatccttatcatattgggcgaaaatagaataaataccggtatcggctgcatgcattgcctgaatccgtcctgcctgagttcgggcaagctgaatacccgagaggagaagagagagcaggatagaaaaaatcaggcacatcgtaatcgtcatacttcctctgcatttcttcacagataaatcctcctgttaaatagaactgctttgttttgttattttgtctaagagtgattgaatcaaagaattgagctgatttttgaaaataatgacaagtccgattaaaacaaccaaaatcagtacaatttcaataacagttacgcctgattcatcttccagaaaaagttttagtaaattctgtttcataagtctcacctcctttctaaggaaaatgtgtgtttgactttaatggctaaataaatcaggtaaaatctaaaaatatagataaatcgattaggtaaaacttagaaatgcgggaagcattagaagtgccagaacgattacaagctgtaaaagcatgggaaagagaagttttgtctgtgcttcttctccgagaatccgtgcttttcgtttgcgattttcaagggcgtccgtgacctctttctctaagagcaggagagtattttgatttcctttttttaagttttgaattaaaagtacagataaaattttgtattccggacagggacagcggctgccaaaattttcataagcacgaggctgtgacagcccaccttttaattcatgacaggtctctaaaagtgcttcgtaagcaggacgtttgggcagattttgactccggtaatttttctgataatcgtctgcaattttttcaagacttgcacgtatcgtaagaccggcatgcaaaaacaacagcagtttactgacaagatcgggataatctctttgcatcagtactttttgcttttctattttttcttgttctttttgccgtttcaatggaagaagtaagaaaccgagcaagctaaagaagatacagacaaaaagaccagtctttgcgggttctttataaaagaatagatgctgcccgtcaattgaatcaggaagagcaagggttggattgcttgaagaatcatttgtaactgctttttgaatggaggcatttaatgatttttctttgcttaatttttcaggataaacataaagctctttctgccatgaaagcgtctcttcttcaagcgaaagctgacagcgaagcgtaacggaagcacccttagaagggacatcttctccgatagcaccggtatagtcgagtattttagggtcagaggttgtccaaaaaagctgaacaggacaatcaggaagagattcgggaagagaaagcggtgtatgaatggaagaaaaactcttattttttccaagaatggaagaatccagtttttttgaggcttcatctaaaagagtctgtgattcctctttgctgtaggttttggatggaactttcagtgtaatatggtgtgtttttccatcgtctgtctgaaatttcagggattcttcgtgaatgctttcattgtattcgctacgttttaaatcagtaacaatatcgggatgtcggctctgccataatccaagagaaattcccagaagatttccaaagagaatcagaaaaatactgactcgcagcagggtttgttcctttgcatcttttaggcttggtttcaagtttgctttaggttttaattttgctttagagtttaagtttgttttagagtttagttttgttttagatttcaatttgaaccatcctcctgccaaagaaaaatgctgtcaggtacaagattaggcagattgtcatgatacagactccggctatattgtgatagagaacatcaagaaagcctggagaggtaagacgcatataaagaataattccggcgggcataagactcataaaggtatgttccattttttttgcagaaagcagagagtcaatttcttttttgacgtcaattttttcttcgatgatgcgtgcacttttttccaaagtttcccgaagatttccacccgttcgttttgcctgtgcaataatctcagaaaagttacggatatcttctacctgactttttttaccaagttcataaaataatttttctaccggaacactgagaagcatctgagattccatgtaagataattcaagaaccatttcgctggaagttccgtaaatacgcattaaatctttttttgcttccgaaactgcattttcaagagaatagccggcagaaacagcggcatcaatagaatttaatgcatcccgaaactgatgataaagccgttttcgtttctcataaagaagctgttttttcttaaaaggaagatacagaaaacaaaagggcagaagaagaaaaaaagaaatcacgtttcggtagcataagtcattgacaaggaagcacaaaatcagagagaagaccgaatactgaatccgttctcgaagagaaaaggtataatggtcataagatagtttcacataagagggtttcataagaaattcctgccctttctaatttttcagtgtgtttcagatgatttttaaagacaagcccctgttcttcttcataacagaaaataggatttaactgtacttctccgttttttagtccatccagttcagagatttctaacactttacggcttttgtcacgcagacgtcccagatgaataaaaaggtcaaagcctgagacaatctgacggcggatggcagtaatcggcatattcaagtgaaccagcacaagggtttcaagtctgctgaccatatcggcacagctgtttgcatgaatggtagaaaggctgccttctgaaccaacattgactgcctgaagcagttcgcttgcttcgcttctgacttcaccgacaataatccggtcgggtctcattctaagtgccgtttttaataagtcagcagttgtgatttcctgtgaatcctcgatatttgccattcgacattcaagacggacaaggtttgggattccctggatttgaagctcagcattatcttcaatggtgataatgcgttcatcttttggaatataagcggaaagtgcatttaaaaaagtcgtttttccggctccggttccaccgccgattaaaatggtataacgtgcttttaccagagggagcaaaaaagataatacctgtttggtaatactttgcttttcgagcagagttttcattgtgatggcttctttaggaaattgtcgaatggttaaaatcggaccatccacagaaatcggcggaatgactgcattgacacgggcaccgttttccagtcttgcatccacaatcggatgcagggtattaatgacacggttacagcgggcaacaatctgttgaattacatcttcaagttttccacttgaagtaaaagtcttattccatgtaatcaagtgtccttcccgttcaataaaaattttgtcccatccgtttaccataatttcggtaatgctggtatcttcgagaagttcttgaagcacatcgagttttcggatggagcgaaataactcttttctaagattggctttttcattgaggctcagaccgtagtttgagccctcctgcaaaagcagttcgtcaattttttcgagaatttcttcatcatcggattcccataaagaatttaactgctcaaaaagctgattttgtaaggttaaaaaacaatccataactatgtctcctttgaaaacttaaaaaattaaaaaaagaaaagataagctataaaagataaaaagctgattgaaattaaaagagaaaattaaaggtatccggctttggaaagttcgtattttacggcatcaccaaatacaccggataaaaaagaatctggaaaatgagaactatcaggagggggaagaaaacaagaatgagttttttctaaaatgagttcctgttttgtgttcgttaaataggctttatactgttctgattttgccatagaaacaggttcttttaaattaggcagaaacaaggtattacattcagaaaaaacaggaaagacagcagaaagatttggaccaaaatcgagaaccagagtctgatagggattttcttccatagcaaaaagagcgaagagcgcttcacagtcggcggaagtaagattccagatatcctgcggaacatagacaggagggagataatgaagcgatccatttttttgaatcagtgaagcaagaaacgcaaaaggattttcttttttgtggcgcagcagataaaaaagatcgccgatggtgtaagcggtgttattagaaagaaaataagacagaccggaacaggattcaaagctgataaaaagagttggatttttttcggaaagaaactgggaagctgcaagtgcaaatgcagtttttccacagcgtgcaaccggagaatagataccgatgagcgtcaggttttgagtgtcagaatttgttgaatgttccattgttaagaaaatctgattggaacaaagtttcattaagtcctgaaaaagctgactgcatggttgatacttaaaaagacagggcagatttttcttataagagagattttcttcagaaagtagaatcaaagtttcagaaaatagagaaataagctgtggtgtcagcatggcttctgtggtaagaagcatggaaattgaatggtcagaatgaaacgtaagaagtttttcgagagaagtaaaggggagaaactctaaagaaagagtgcagttttgttgaaagccagaacagagacgacagataaaatcttcgttagaatcgtaaagtgcaatgatttttttggtcataaacaaaatcctccaattaagagcagggtggcaagaaaaatgggaactgtaaaatgaaaatgttcaggacgatttccggatttcatatagggatgaatttgttttttggaaaaaatatcggagacataagaaaagaaataagaaattcgttctaagaaataggcagagcttaaaaacagcaggcaggaaatcaatgcgccgatgaagaatgaaaaagcaatcaaggaaaaaatgtcggaaaaattgagaaaaatgccaagcgtaccaaaaagctttaaatctccagcccccattgcgtgaaaaataaacagtggaaataaaatcaggatgggaagaaaaaaatttttcagggagaaaagcagaccaaaaaagccgttttgaaatatctgataagagaaacccagaagaataccaagaaaaatccagagatttggaactttttgcaagaataaatcacagcagagagctccggcagataaaaaaagcagaaattgagcctgtaaaggcataaatataccagtcctttctgagaaaattggtaaaaataatggaaaaatcatgaaaataaggaataaaaatgacttcgacgaagtgaactaagaatttaagatgtgaatgattatatactttatttcgcccaatgtccagttaaaatgacataaaaaaagatttttgttaagacttcacaaaattactatttgcaataagtgtcattttcagttaaaatagatgttatacaattaggtggacaaaaagtccattgctgaaggagaatagccatgggtgtaattgtatttttaggtgacagtattacagatgcggggagaaccacctcttgtccgccgcttgggaatgggtatgtaaagggatttgcagactccgtcagtcagaattggaatgttttaaatcagggagttgatggttacattacggaacgaattgcagaagacctgcataaggactgtattgcgtttcatccgaattatgtaagtatccttgtaggaattaacgatgtaggactgatagcagaagccgacacaacagagcatgaaaaattgtatatgttggaagatagtattcgtgcttatcacgaaatgttatttgatttatcccgagagacgcaggcagaaatcatcacactggagccgtttattttcccaaaagatggaaaatatgaaaattgggtgccttggcagaaaaagatgtcaaagaatattagaaaactggcgcgtaattaccacgcaagatttatttcggttcaagaacctcttaatcgcgagattgaaagattgggacatgatgccatcaccacagattgtattcatttgaccgcaaaaggtcatgaaattctggcaaagattgtcagagatggatttggactttaaaacaagggagagagtatagttggttaaaatactctctcccttgttttaatacaattcccggaaaaatttctgaaccaaatcaaatcggcttgtcattccggcaagcatggcatctaagataaccagggcagccatacattctactacaacaaccgctcttggaacgataatcgggtcatgacgtcctttgattgagatatccagattttcgccggctcttgtgacactttcctgagtggcagaaatagatggagtcggtttaaatgctgctcggaataaaatttcacatccgtcgctgattccgcctgtgataccaccggaatggttggtctttttcgtaatgtggccagcttcatctgcacagtaagcatcattattatgaagtccgtcggattgtgcaactgcaattccatctccgatttcaaaagcttttacagctccgatagaaagaatggcttttccaaggttggcatttaatttctcaaaggcaggttcgccaattccggcaggcacgccgataatcatacattccaccattccaccggcagaattttgttcttgcatgcaggtttcaagatagtcggaagctttttttgcagcctctgcatcgggcatataaagcggattattttcagcttccgataaatcaaatttttctttattaatagcaacaggtccgatggacaaagtataggcggaaatctgaattccaagagattttaacattttcgccgcaactgcaccggcagcaacacgaccgatggtttcacgtccggaagaacgtccgcccccacggtaatcgcggaatccgtatttgatatcgtaattacggtctgcatgtcccgggcgataataattggcgatttcactataatcatgagaacgctggtcggtattttttaccataagggaaatcggagtaccggtagtctttccttcaaagacaccggaaagaatttccacgcggtctgcctcctttctcatggtggtaaaacgggactgtcctggtttcctgcggtcaagataagtttgaatatcctcttcacaaagcggaagtccggcagggcatccgtctatcacaacaccgatgccttttccatgagattctccccaggttgtaattttaaacaggtttccaaatgttgaaccaaacatagtttacacctctttttctttcgtcttacttgtcgatggattcccagcgtccggaagctccacatggaagcaccagcccgctttcggtaaccggaagaccgatttcctgtgaatctacttttccgttaaattgttttaattcggttgaaatcatataagttaaaacagcaggagcaagtccggttgtataggagttaatcaggaaaaacagaggattgtcacttaaaagtttagcacagagctttactaatgggtgaattgcctcttcaattttccagatttctccttttggtcctcgtccataagatggtggatccatgataatggcgtcgtagtgatttccacgtctgatttcacgttctacaaatttgacacagtcatcaaccagccagcggattggtgcatcgccgagtccggaagaaatggcattttcttttgcccaggtgaccatgccctttgaagcatccacatgggtaacatgagcaccggcagcagcagcggcaagagttgccccgcctgtgtaggcaaagagatttaatactttaatcggacgaccggcatttttgattttttcggaaaaccagtcccagtttgctgcctgctccggaaacagtccggtatgtttaaaactgaatggctttaagttaaaggttaaatttttatactgaatcgtccactgctttggcaggtcaaaaaattcccattctccgccgccttttttactgcggtgataatgcgcattcatttttttccatcctttgtgagtttttggagtatcccagataacctgagggtctggacgaaccagaagataatcgccccatcgttctaatttttctccatttgaagtatcaatgacttcataatctttccattggtctgcaatccacatagtgaaatcctttctatttattagttaactaaaaatataatatgagtgtcaaaaggtatcaattttcttcatattcgttaattagtatagcagaagcgcaaagtcgaggcaatgcgcaaatcaaacagaaatgagttattcttgaaaaaatatctgcatacattgagatagaatatatcattgttaagatacgaacctgcaaaagggaagaaactaccgacaggtcagtatgaaaaatcaggagggcttatgtacgaacaaatggaatgtggcgaagtgtgtaaaagatttcatacagatgagaaagctggactgacgcaacaggaagcagagaaaaggttaaaggcagatgggaaaaaccgattaaaaaaagtcagggaagagacaacgatagaccggattcaaaaacagttaaatgacccgatgatttttgtcctttttatggcagcgtctgtttctattctgcttagagaatttagtgatacggcaattattttattcgtgattggtttaaatacgatgataggtgtagtacaggagggaaaagcgaaaaaggcgatggatgccttaaagaaaatgacagcaccggaagccaccgtaaaaagaaatgggacttaccgaaaaattccggcagaagaacttgtaaaaggcgatgttgtaaaagtgaaagccggagaccaggttccggcagacattcgtttgtttttgtgtaagggaattgaagtaaatgagtcggcattgaccggagaatccacggcagtaaggaaagcctgcgagacgatgaagcaggaggttacagcctctgaacaaaaaaatatgctgtttctatctacggaaattgtgaagggaaatggagaaggaattgtagttgcaacggggatggagacagagcttggaaaaatagccaagatgataaatgaacaggaaaatgaaatgacaccgcttcaaaagagattgggagatctggggaaaatcttgagtaaggcggctgtttttttatgtctgttactttttttgatgggagtgcttcaacatagaaatctgttacagatgctgttgttatccatttctctggcagttgcagcaattccggaaggacttcctgcggttgtaacgattgtactggcacttggtgtggcaagaatggcaaaagccaatacgattatccgtaaattaccagctgtagaaacacttggagcggtcagtgtggtttgttctgataagaccggaacgttgacggaaaataaaatgaaagtgttgaaactttatgcggaggataaaaccttatcggtttctcaggttcgaccaagagaattttcccgtttgatgcagggatttttgctttgtaataatgcagtaatcggaaagacggaactgggggattccacagaacttgcacttctttctatgggagaacagatggggatatcgagagagcggttggaagaacgttatccgagattggaagaaattccgtttgattcagataaaaaatacatggttacgctgcataaagatcagagtcaagtatgcgcttatataaaaggtgcctgtgattatctgttggaagtttgtagtttctggtggataggaggaaagatagaaccgcttggacagattcagaaaatgaaaatcagacgagtaatggaagggatggcagaagagggacttcgggtgctggcactggcttttaaagaacatgtatcagactggaatgaaagcagtattatgaaaaatctggtatttgcaggacttgccggaatgatggatgcgccaagaaaacaagtaaaccagtcagtctatcaattaaaacgtgcaggagttcaagtcgtaatgattaccggtgactatcaggaaacggcattttcaatcgcaaaaatgaccggtattgcaagaaaaagagagcagtgtgtgaccggagaagaattagatgcaatgagtgatgcagaattttcttctaaaatgaatgacatccgtgtgtttgcaagggtaacaccggcacataaagtaaaaattgtaaaagaatttaagaaaaatggaaaaattgtggcaatgacaggagatggagtaaacgatgcaccgtcccttcatgcagcagatatcggaattgcgatgggcgcaaatggaacagatgtggctaaaaatgcggcagatttgattttggcagatgacaatttttccacgattgaaaaagcagtggaagaggggcgcagtatttatgtcaatattaaaaagtcgattttatttttattgtcctcaaactttggagaaattatgacgatgtttgtgtcgattgcattttcgatgccatcgccattaaaagcaagccatattttatgggtgaatctgattacagattcccttccggcactggcgcttggtgtagataaaaatgataccggattgttgatggcaaagaagccaagagatgagaaggaaagcctgtttgcgcatggaggatggctgcttacgattgggtatgggcttttgattggtgcgattactttgtatgcgtttctgacaggcggacagacttatgcatttacggtgcttggaatttcgcagttatttcatgcaatcggaatgagggattgtgagaaatctatttttcagatgaatcatctggaaaatccggttatgattttttctttttttacagggcttgcacttcaagtggcagtgacagagattccgtggctggtggaagcatttcagacccgtcgccttttgatgggagaatggctgtggctgttgggaatttcggcggttccgcttgcggtacatgaaatagtggtgctcataaaacgattaaaaaaagggtgacggtgtaaatatgcaagattttatataaaaaattgcatttaaaacacaaaaattcgtgtataagagataaaaaacgatgaaaatgcaagaaagacttgacaatcagtcataaagtagcatacaatactgcttagtaagccgaagaaaaatgaattggatggcaaattgaaaaaatcaggaggagagccatgacaccgtacagagaactcaacaaagaacagctgcaggtgctgaaagcccagttagaaaaagaatttgaagaagtaaaagcaaaaggtttaaacctcgatatgtccagaggaaaaccgtcaaagaaacagcttgaacttgctatggatatgcttgaagaattaaagagcacagataagctgaaatgtgaagcaggaattgactgtcgtaactatggtttgttagaaggtattccggaagcaagaagacttcttggagcaatgacagaggtaactcctgataaaattattatttttggaaactccagtctgaatgtgatgtttgataccatttcccgttctatgacacatggtgtctgtggaaatactccatggtgtaagttagacaaagtaaaattcttatgtcctgcaccaggatatgaccgtcactttaaaattacagaatactttggaatcgaaatgattactgttccgatgactccaaccggtccggatatggacatagtagaaaaactggtaagttcggatgatgcaatcaaaggaatctggtgtgtaccgaaatattctaacccacagggaattacttattcagaagagactgtaaaacgctttgcaagattaaaacctgcagcaccggacttccgtatcttctgggataacgcatactgcatccatcacttatacgaggagaaagatttcttattagagattttggaagaatgtgaaaaagctggaaatccggatcttgcatataaattcctttccacatcaaaggtaagtttcccaggctccggtattgcagctgtagctgcttctcctagaaacttggaagatatcaaaaaacacatgtcaattcagacaattggtcatgacaaaattaatcagttaagacatgtacgcttcttcaaagatatcgatggtatgcatgaacacatgaagaaacacgcagaaatcttaagaccgaaatttgaagcagtggaaaatacactggaaaaagaaatcggcggacttggaatcggtgaatggaccaatccaaaaggcggatatttcatttcctttgaatcaatggaaggatgtgcaaaggcaatcgttgcaaaagcagcggaagccggagtgaaaatgacagatgccggagcaacttatccttatggaaaagacccgcatgattctaatatccgtattgcaccaagtttcccgaccttagaagaattacagacagcaacagagatttttgtattaagcgtgaaattagtcagtgtagaaaaattactggcagaataagcataaaaaaagccatttgaacattaaaaataaagggcgggattccaaagaaaaggaatctcgcctatttttggataaaaatcacaatttggtcacagaatagggctttacttttgggataaagatgaattagaataaggaatgcataaaagaaaaataaaagaatcaaagaaaaaggggtaggaatatggaacagaatgaaagtggtaacaaaaaaaccgcaaaaccaaagaaaatcataattggtattctgattgcatgcgtggcggtgcttgcgatactctatgcggcaggagcattttatttttccagtcattttctcccgggttcaaagataaatggagtaaattgttctggaaagacacttgagagagtggaaaatcatctgacagatgaaatttcttcttatgcgcttactatcaaggaacgtggagataatacagaaacgatttctgcagataggataggactcagctatgtggatgatggaaaagtggaaaaacttttaaaaggacagaattcatggggttggattactgcatttacaaaaaaacatgaatatacaatgagtgcaaccaccacggttgatgaagaaaaattaacgtcagcaattgatggtttaacttgtcttgcagaagaaaacatgcagcagccggtcgatgcacatttggaaatcggtgataatggatacgaaattgttccggaaacagaaggaaccgctctggataaagacaaggtaacggaggttatcacaaaggcagtcaaagccggagagacagaagtagacctggaagcttctgactgttatttaaaaccatctgtttatcaggatgataaaaatctgattgcgcagagagaccagagcaatgcattcttaaaagtaaaaatcacaattgatttttcagaccgtcaggaagtagtagaccagagtttaattaaagactgggttacaacagatgaaaatggaaatgcagtcttagatgaagcaaaagtaaaagcgtatgtggtagaacttgcaaagaaatatgatacctttggttatccaagacagtttaagacctctaccggtgaaacaattaccgtaagcgggggagattatggctggctgatggcaagaaatgataccacaacaaaattaatcgaggcaattaaaagcggaaagtctcagaccattgaaccggaatatacatataagggatacgtacgtgacacaaatgatatcggaaatacttatgtggaagtcagcctttctgcacagcacatgtggttttataaaaatggtcaattacttgtcgatacagatgtcgtaaccggaaatcataatctggggcatgacaccaaaacaggtatttatgcaattatgtacaaagaaagaaatgcgaccttagtaggggaagattattcctcgccggttaaatactggatgccgttttatgcaaatgttggaatccacgatgcaagctggagaactacatttggtggaagcgagtatttaaataacggttctcatggctgtgtcaatacaccagaagccaatgcagaaaagatttttaataatattgaaaaaggtgtgccggtagtggtgtactaaaacttgagaagctgttgctttagcgatggaaaaatcgtggagtgacagcttctttttgtatatattagtgtatgtatcaggggtgataattcttttggaagtgttttttgtattgcagattgtgtttcaaatgcagtggaacattgacaaagaaagaaaaattgattaggataaagaaaacacaaaaatcaatgtgggcttttataaagttcatgattagaataaaagggagaaaacaaaatgaatatcgtagttttagcaggtggaaacagtacagaaagagatgtttctatttcatcaggagaaggcgtatgcagtgcacttcgtcagaaaaatcataaagctgttttagtagacgtatactttggaaaagaatcttttggggaagaactgtttcctgaagtctatgatgtaaaagcagaagcagacagcatgagagaaatgagtaaattagtggaagaaacaggaaagaccagaaaagaattttttggaccgaatgtactttctatctgtaaagcagcagatatcgtatttcttgccctgcatggagcaaatggagaggacggaaaagtacagtctgtctttgaattaatgggaattccttatactggaaccggcccgctcagcagtggaatggcaatggataaaggaattacaaaaatggtatttgaagcaaaaggtgttccgactccaaagggcgttactttagctaaaggaaagagtgaaacagcactttctgcttatgatatgaactatccggttatcgtaaaaccttgctgtggcggttccagtgtgggagtctgcattgcaaatgatgatgccgaatatgctgacgctttaaaagaagcattttcttatgaagatgaaatcgttgtcgaacagtttgtaaaaggacgtgaattctctgttgcagtagtagagggaaaagcctatccgattatcgagattgcaccgcttcagggcttctatgattataaaaataaatacaatgcaggttcaactatcgaaacttgtccggccaaaattacaccggaacagaccagtcagatgcagacttatgcagaacttggttacaaagtattaaatcttcaggcttatggcagactggattttatcatggatgaaactggcgcaatgtactgccttgaagcaaatacccttccgggaatgacaccaaccagtctgattccacaggaagcaaaagttcttggaattgattacccggaattatgtgaaaaattaattgaagtttctttaaagaaataccagtaggcggagaaaaattatgaaaaatcttacgttagaacatattgcacaggcttgtaatggcagttatcatggcagtgaagcacaggcaaaacaggaagtgcagagtatttttacagacagtagaaaagcggcaaaaggcggtttatttgtgccgattaaaggggcaagagtagatgcgcatgattttattgatcaggtcatggaagcaggagcacttgcaaccctaagtgaaaaagaccttggggagacaaactttccatacattaaagtagaatcctccttacaggcagtaaaagacattgcggaattttatttaaaacagttagagattccggttgtcggaattaccggaagcgttggaaaaacaagtacgaaagaaatgattgcagcagtacttggacagaaatataatgtgttaaagacacagggaaactttaacaatgaactgggacttccacttaccgtatttggacttcgtgcggaacatcagatagcagtccttgagatgggaatcagtgactttggagaaatgcacagactggcaaaaattgcacgtccggatacctgcgtgattacaaatattggtctttgtcatcttgaattcttaaaatcaagagatggaattttaaaagccaaaacagagatttttgatttcttaaaagaagacgggcatgtcatcttaaacggagacgatgacaaattagtgaccgttaccgatgtcaaaggaatcaagccggtattctttggtgtggaaaataaaaacggaatctgggccgatgaaattgagagcagaggcttaaaaggaattgaatgtcggattcatgtaaaagatgaaagttttaaagtgctcgttccgattccgggacgccacatggtttataatgcccttgcaggaacagcagttggtttaacttatggtttaaccttagacgaaatcaaggctggaattgagagcttacagtccttaagcggacgcttccatatcttggaaaatgagaagaaaaatattatggttattgatgactgctacaatgcaaatccggtttctatgaaagcttcccttgaagtgcttcaggatgcactcggacgaaaagttgccctgcttggagatatgggagaacttggaaaaaatgaagtggaaatgcatcgtgaagtcggaagatttgctgccgaaaaagacattgatgtgattgtgtgtacaggaacattatgtaaagaaatggcagaagcggcaaaagaagtttcaaacggaaaaaaagtattatactttgaaaacagagaagcattagaagatgcactggatgaattaattttgccaggtgacagtattttagtaaaagcatctcactttatgcagtttgagaaaattgtaaagaaattagcggaataataaagaagaagtttaagtttattgcttttgcgaatagaaaaatgatggtacatctgataaaatgaaactatagaaaagtacaacgatagtttcgatttgtatgctgattaggtaaggaggtatcatcatgaaaaaaacaatttatgtatgtatttctgctgttttgttaatgtgtttgattgcacttatcacttattatattccggacttaaaaatcaagatgcttgtatcttttcttgttgtgttgacaggaatttatacgattagaatgggtatcattcagaaaaaacgttaattgcatagtaatataaaatgggctgacatatcgagtagtttgatatgccagcccattcttttattcctcatgcgccacaatattttgcaaccagactccttttttcactaagataaatccgatgacacatttaatgatatcacccaactgtaccagcgtatagattccaataaccggaagtgccgtaaaacggcttaacgtaaatgcaatcgttacactcacacaccagataaatacactgtcaaacaagaaggtgataatcgtctttccgcctgaacgaagggtaaaatatgaagcatgcagaaatgcattttgtggcatgaaaattgcggtgatcatgataaagtattttgccagttcccttgcttctgcattggtgttataaagcaatgggaagaatggtgcgagtaccagcatcacaagtgccacgcaggtacagcaaaatacggaaaaggcaatcatcttggtatcggtttctcttgcctttttcatttctcctgctccaagcagctgtccgactacaattgcgacagaatctccaagtgcaataaatacaatattaaagacattgttaatggtattagaaatatttaaaccagctacgacatttaatccacgaaccgaataacattgcgtcagcattgccattcctgctgcccataatgcctcattaaataatagcggtgttccttttatcaagattttctttgtcatataagccggtacttttaaggtacgataaagtccttcgatataagggtttttctctttatggcggtgcgtccagctgataacgatgatggcttctacatatcgagaaagcacagttgcaatcgcagcacctcttactccaagaaccggagctccaaattttccataaattaaaatatagttaaataataaattaattaaaacggctgtaattcccgctttcatcggtacaaccgtctcgccacactcacgaagggtacttgcgtaaacctgtaccatcataaatggcggaagtccgacaagcataatccacaaatactgttttccatacagtaaagttgctgctgcattttcccttgcaccttctccatgcagatacagctcaatcagccggtccccaccaactaaaaaaataacaatggttgctaccgtaagaatcagtgccatccataatttatagcggaaggtatttctgacgccctcctggtctttttgtccaaaatactgggcggtaaaaatacctgctccggatacacctccaaagatgcagagattgtatacaaaaataagctgattgacaatcgctgcgcctgacatctgttctgttccgattcgtccaatcatgatattgtctaacagactgacaaagtttgtgattccattttgaatcataatcggaacagcaatcagcagaatcatcttatagaacttcttatccccgattaactttgaggcaagtccctgtttttttactgctttttctcccataacttctcctttctcctaattcccatccaacatacagtgcgaaagctgtaagggataggatactacacaaacacaattttttcaattgtttttttcgacaatcttttttgccgttttttggcttgctatccaaaagctttttgcttataatatctcttgaatattaataatataccatacggtatagaaaggcggtttttatgatacgttttatttgcgtatgtatcgtagtcatcggttatctgattttatccattccgattctgcttgtagaatgggtcattggaaaattcaacaaacgtgcaaaagacattagttctcttcgcattatccaggcagtctttcgttttatcctgaaaattaccggagcagatattacggtaaaaggacatgaaaatgttccggcagatacagcagtcctttatatcggaaatcacagaagtttctttgatattctgctgacttatgtactctgccccgatgtcaccggttatgttgcaaagaaagaaatggaatccattcctctgttatcaatatggatgcgttatcttcattgtctcttccttgaccgtaaaaatattaaagagggaatgaaaacaattcttttggcaatagaagaaatgaaaactgggatttctatctgcattttcccggaaggaacaagaaatcgaaatgaaagtgaactcgatctgcttccgttccatgaaggaagttttaagattgcaaccaaggctggatgtccaattgtaccgattgccattcacaattcagccggaatttttgaagcgcagtttccgaaaatgcgaccggcaaaagtaatagtagaatatggcgagccgatttatccggataaactggataaagaagagaaaaaacatattggtgcgtatacgcagaatgtgattttggaaatgttaaaagaaatgaatcaatgaaaataataagattatcaaaaaaaactctggctaaaaggtcagggttctttttttttgctctttggcatacattattggtaagtcagcgaaggaagggcaaaatgaggcaaaaaatccatacaggagtgttattgtggtcggttgttatcattttattagcgctatccggctgttcgattgaaaaagtaagcgcacaaaaacaggataaaatcgaatacactattttaaaagaggcggaatttccggaaaaagtgcaggagttgatagaggaaaataaaacaaaagagtttcagcttacttatcaggaacagggaaatttgtatctgataaaggggtatggagagcagaaaacaggcggttacagcatccggattgaggatgtttctctttgggagaatgccatacatgtacagactatgctgattggacccaaagaagaaaatttaaaagacgaaccgtcctatccgtatctggttattcggatggaagacagggatgaaccggttatttttgagtaaagtaaaagcagaaatgataaaaagagatagaaaagagggtataatgtggaactgattacaaaacgagtacatacaatgcggacgaaatgtgaagcagtaagtcaggttacgtttgatgaagatttgaatgtaccggatgtaaaaccggatgtgggacgtatgatacaaaagaaaggagaaatccagatagacgaaatgcaggtatcagacgggcatgtcttttttaacggagcactattggtggctcttttgtatgtcagtgacagtatggaacgaaagatccaaagtctgctcggtacactgccgattgcagaaaccatgcatttagaagatctgcaaagtgggcagaaagtaaaacttgaatgggaacttgaggacttgagtgtccagctgattcattccagaaaattaaatattaaggcattgattacatttactgcaagggtggaagaacttgaagaaattcttctgccggcaggagtggaaacccctgagatttcccagaaaaaagaagaaattccggtaatgggaatctgtatacataaaaaagacaccatgcgggtaaaagaagaaatttcccttgcttcgaataagcctaatattcatgaacttttatgggatactgttgaaataagaggtgtggacattcgtgcaaaaagtgatagaattgcagtaaagggagaactatttttatttgtactttaccggggagaagatgataactactctcttcaatggctcgaacattccattccgttttcggaagaaattgagtgtgcaggctgtgcagaaagcatggtgccggatgttgatgttttgcttgcgcatagtgaattgaaaatccgaacagacagtgatggagaagagcgagtgcttgcagttgaagcgatgctggaacttgaaatccgaatttatgaggaagaagaggtttctcttttactggatgtgtatactccggcaaaggaacttcgggtggtctgtaagccggcaaaattagaatgccttttagtaaaaaatttttcaaaatgcagagtaggagaacgtcttaagacaagtgaaaatcaggggaaaattctgcaaatctgtcacagtgacggaatggtaaaggtggacaatactcatattatggagaatggaatagaaatagagggtattgttacggtcaagattttatatattatcagtgatgacgaaatgccgttttattcgatggatgcaatgattccattttcacatattgtggaggcacagggaataggaaaagaatgtatttatcatctgcatacggatttggaacagctttctacaacgatgattgacagtgacgaaatagaagtaaagattgtattgaatctaaatgcgttggtgatgaaacaaagggaacggccgttgatttatgaaattgaagaacaggaactggacagagaaaaactgcaaagtatgcctgggattgtgggatatcaggtacagcctcaggatacgatgtgggatattgcaaagaagttttatacgacaacagaagagattatccgtctgaatcatctggagtcagaagaacttcatccatttgatacgttgatacttgtaaaatcagttgagagtaaataagaaattttcctattgaaaacgaccaaaagatgggctagaatgaatgtagaatgtttaaaaaagaatacaatgtacaaagaaatatacaggagaagaaaatgagattaagagcgttggcaaaaattaatctgggattggatgtaatcgggaaacgtgaagatggataccatgaagttcgtatgattatgcagacaatcaacatgtatgaccaactggagattgaaaaaaaagacgaaccaggaatttccattacaacgaatcttccatttattccgacagatgaaagaaatttagtttataaagcagcaaaactcttgatggatgaatttgatattcaggagggaatcacagtcgagctgcagaaatttattccggtggcagcaggaatggcaggaggcagttcagatgctgcagcgaccatgattggcatgaatcgtctgtttaatctggggcttactgtaaaagagatgatgaaacgtgctgtggcaattggagcggatgtaccatattgcctgcttcgcggaaccgcacttgcagagggaatcggagagcagttaagacctcttccgccatgtccgaactgctacgtactgattggaaaaccggcgatcagtgtttcaactaagatggtttatgaaaaattagattctgcccaaattgagcatcatccggatatcgatcggatactggaggggcttcagtggcataatttaaataaaatatctgaatatatgggaaatgtgcttgaaaaagttacgattgcacagtatccgataattgaggaaatcaaaaatcatatgaaagaacacggagccgtaaatgcaatgatgagcggaagcggaccgacggtatttggtttatttgatgataaagacacagcagagcatgcatgcgaggcgcttagagaaagcaaaattgcaaagactgtatttttgacaacagtatttaacaacggaggacactgataagatggatttagaaatgcatatggatgaatacctgcctcttagggatgtggtttttaatacattaagaaaagcgattttaaaaggggatttaaaaccgggagaacgactgatggaaattgcacttgcagaaaagttgggggtaagtcgtactccgattcgagaggcaattcgaaaactggagcttgaaggtttggttgtgatggcaccgagaaaaggcgcaaaagttgcttctattacagaacgtgatttaaatgatgtacttgaagtaagaaaaggaatggaagaacttgcaattcgccttgcgtgtgagcggattacaccggaacaattagatgaacttgacaaagtagaaaagaagtttttaaatctgattgacagcgaaaacttaacggaactggctgaagtagacgtagaatttcatgatattatttatgcgacaaccaataataaacgtctgattcaacttttgaataatttaagagagcaaatgtaccgttatcgaattgagtatttaaaagacagtgcggtaagaaggcagcttgcaaaagagcataaatctatttgtgaggcacttcgtacgcatgacaaagaaagcgcactgcgttatgtttatgtgcatattgataatcagcaaaaggcgattatcagaagcctgaatgaagaaaaagaagaataaaaactaaaaaaatggaaatgttaaaagagatgccaaaagaagggcatctctttttattgtgcaaaaaatatattctataaaatatcgggggaatatgatttatgagccattctatcagtatttcaccaaagataaaagaaaatgaatcctgttttcgagaagtattcaaagactgtgcggatattttgttccatacaatggaacttggtcggggaaaaacagtcgactgttttgtgatttatcttgaagtagcggtcagcaatatgattctcgaaaaatccgtacttggaaaattcatcaatgaactgtgcaaggtatctggagatgagattttagagcgggttgaaaaaaatgcattgggaatttcagatgcagtacagctggatacggtagaagatgtggtcgcaggagtatttgccggagatgccgtattttttatagatggatatgcgcatgctgttaagatttcagaaaaaggatatccttcgatgggagtatccgaggcagacagagagaaagtactgcggggttcaaaagagggatttaccgattccgttaaaaccaattcggcactcatcagaaaacgaatccgaaatccgggaatgaaagtcaaagagcagacaattggaagacgcagtcagacaaaaattcagattctttatatcgaaggactggcaaggagtgagattttagaagaactcgagacgaaactttctgattttgaaattgacggtgtgcttgacagtggagtgattgagcaactgacaaaagaaaactggctgtcgccgtttcctcagtttcagacaacggaacgaccggataaatgtgcgatggagctgttaaatggaagggttgtcctgcttgtggataattctccggttggtcttttaattccggcggtgtttaatgattttttgcaggtgagtgaagatgaatatcagacctttgaacttgcaacatttttaagagtgctacggtatctggcagttggttgtgcaatgttgttttcgggactttatctggcggttacggattttcatacacaggtattgccgacgaatctgattttatcttttgcaaaggccagaaggggtgtgccgtttccgggtctgatagagacattatttatggagattgcatttgaaagtgtcagagaagcgggggtgcgtgcgccgggaccgcttggaggtacaataggaatcgtaggagggctgatcatcgggcaggcagcagtttccgcaaatctggtcagtccggtggtggtagtggttgtggcggttacagcactttctgcccttgcaattccaaatgaggaattttctgcaccgtttcgactgttaaaatttggctttatttttcttggcggaacacttggaatgtttggaattcttttgggactctatatgcttttaagccatattgccgagctgaaaagctttggagtgccttatcttgcaccttatgccggaacgcaaagagcgggatacaggggaaaagaaaatggaatctggatgcttccggcaagatttcggacaagacgcccgctgtatgcaaaagaaagtcagaaaattaagcttagaatgaaaacatcggatgaagaggaaagaaaaaatgaaatatacagaaaatgaaacaatatcgcaaaaacagcttttttctcaggcaagtgtttccatgctgggcttaagcctgatggcagttccggaatttatgagattttcgttgaagacgatgatatttggactggttttaacaggattatttttctgggtgcaaagtatttattttgttcgtatctgcccatgctatgccagactttgcacttcgtttggaaattgggtgggaaaactgtttggatttatctatgtatcttacctgtggttcagtcaggtcgtgctgttatgtttgatagcagaccttgccaattattattttatagaacgcatcgacaaaagttggctgattcttttaacaggtatcgtttgtgcaataggaatgtatcaaaatgttgagaaaagaggcagaatcggagaaatcattctgccggtaattttattttttattctttttatgttatttcttgctttccgggatttctcatttgaggaaattatcagggagagccggagaaaaatgacgctaagagagctggcagaggcattttataaaattgtatgtctgtttttgccagtatatttttttccgtttatcttaaatcagacgaagcgaaatacatcggcaaagaaaagcatgaatggaagtgtctgtctgaatcttggaattttacttttggctctgttcctgcttttaggactgcttggaagagaagggtatatgcataaaaaatatccgatgattgatttaatgtcaggagtgaacctgtcaggagatttctttcaacgttcggatctcttttggagtggaagcctgttgttttgtctgttttatttatgtggaagtatcttcttttatcagcatgaacttttaaaacgctgtagattagaacgaggcacatggatagtatatgccagtgtggttttattttctgtgtttgcaggaaaacttgggttttcatttgaaacatatcgtacgctggtccagtatgggtatgggattatgtttccggtcttgatactcgcagcaggaatctggtataaacgaagaaagatgggaaggcgggagcagattcatgaagaaaatacagataaataaaatacgttgtatttttgcagcgtcactcgttgttgttacagcagtttttctaaatggctgtggaatcctgcttgaggatagaacttttgcactttctttatctgtggattacaaagagggtgaatatctggtctggtatggcatttcagatttatacgatgaggtgagtgagaaagaagagagcggtgaggtgaacgaaaaatcggaaaccgaattgaaaggcataagcatggaagaagcaagaaataaatttttgtcaagtcaggaaaatgagctggatatgggacatttaaaagcattgattttgggaaaaggaattttagaagatcaaattgcttatgagggacttttaaatcatcttgaagcacagccggcggtggcatccaatgtatccgtctttttctgcaatgaaatagaagctctaatgaaaacagaaagacagcaggaaattccgcttggggtgtatctgactaaaaagccgaagaaccagtcaaaaaaaacagtcttttcacctgtaaaacttcaggagctttacaggctttggtataatcagaaaaagcagccgagccttccggaaataaaaattttgcaggaaaaaattgttgtacagaataaaccagaaaaataaagtcgatactttgtctgtagagagaatcaaaacaagaaaagtaaaaacagaaaatgaaaaacaaaataaatcaaaaaggcaggcaaggtatgaaaaatgtgagaaaaaagagcgaaaacatcagatggaaattatggatattgtcagccggaattgcacttttgctgatggctggcggtgtccgaatacataagttaaaagaagaaaaatatgaacttcaaaatcggttagaaagagaagtacagcagaacattgcaaaggaagtgcttcggtttcatgtgactgcaaacagtgatacaaaagaggatcagaaattaaaaatgcaggtcaagacagagctgttagaatatatgaatggatttttaaaagaatccgatggattagaggagacaaaagaaatcgtgctgggacatcttacagagattaagcagactgcaaaagaaattgtggaagaaagtggttatgagtatcgagtggaagccaaaatggagaaatgtgagttccctgagaaagtttacggaaactgtacgtttccaaaaggagaatacgagacattgacagttacgattggagctggaaaggggcataactggtggtgtgtactttatccgagtctgtgctttatcaatgattcttatggtgtggtggcagatgaaaaaatagaagaattaaaaaaagttttaacagaagaagagtttatttccatctggaatgatccgaaagaacgaaaaaaagtacggatttcatggaaatggttttaagatgtagcttgcaatccgtaatcaataagggtaaaataagatgaaatacgcagtaaaagagaaaagcgaggcttttttatgaatcagaacagacaagcgccaattggtgtttttgactcaggtgtgggcggactgactgttgcaagggaaattatgcgaaatctgcccagcgaaagaattgtatactttggagatacggcaagggtgccttacggaagtaaatccaaggaaattgtattaaaattttcaagacagattgtaagatttttacagcttcaggatgtaaaggcaatcgtagtggcatgtaatacagcaagtgcactggcattagaagagataaaaaaagaaattgatattccgattatcggagtggtggaacccggagcgaaagttgcagcttcggtgacaaagaacaaaaaaataggtctaatcggaacaaaaggaacggttcattctaaattgtatccggaaattattcacagatatgataaggaaattcaggtgtttggacagccgtgtccgctttttgttccactggtagaagaaggatggctgaaagatgatgtaaccgtagaagtggcacgacgttatgtgactccgcttttggaacaggggattgataccttgattttgggctgcacccattatcctctgcttcgttccctgattcagaaactggtaggagattccgtaacattggtgaatccggcttatgaaacagcaaaagaactcgaacggctcttaaaaagtaaagggcttgaaaatcttcaggatgttcaggaagaatttccataccgcttttatgtcagcgatgccgcagaacagtttcaggactttgcaaattccattcttccgtatgatgtaaagatgacaaagcagattaatattgaggagtactaaaattatgaaaaaagatgtgctggtaacagtaagaggaatgcagtcgattgaatccgtggatggttcggaagaagtagaaatggttgcaaaagggaattactactttagaaatggacatcatttcatctgttatgaagagatgtcagaagggtttgataagccgaccaaaagtatgattaagattgcagataatgtagtggaagtggacaaaaaaggtgttatgaatactcatctggtgtttgaaccggaaaagaaaaatgtgactttttatgcgacaccgtttgggcagatggaaatgggaattgcagcaacaaagattgctgttcaggaagaagaagaaaatttaagtgtctcgattgattatgcgcttgaaattaatcgcatgcataccgcagactgtcagcttcatgttcacgtacagtcaaaagaagcaggagattttcgtctgtgctcataaaaaattttgtcagcaataaaaaagcattgagactttctgacgaaaaagtttcaatgctttttttaaattattttttactgttgtcttttgtcatctgatttgctttcgcacgcatctttttaaagaagccctgttttttaggcggagtttcaagagagcctctcacacctttgacacctgtgatgtagataccactgacatcagcttttacttctttttttaccggaattaaatcaaatacctgttcatcggcaacaagtgtcatgattcttggaccgacttttgcttttacgattggcagcttagaacgtctcataagttttggagtctggtcaattaccatctgaggcagaccggattctttaatcggaagacgcttcttatcaataatcagcatcggtattgtctgttttgctgcttcaatctgttcctgctgtgcttcttgtttcttctgggcttttttgccgagaaaatataaaacggcaagaccaattactataatcagtaatacaatcagtagaacaatccatggactcatttgtaattccctcctaagtatggctttctgacgtatttattattttagcattgtttttgggaaaaggcaataaaaaatatgcaagaaagggtttcttttaaagaaagttatggtataatgggaacgcttggagaatcgcttcaggccaatgcactgcagaaaaatgacgggggatgcagctgcttaacaacacagagaaaggatttataaatcgatgaagaaaaaagtattaattgctcttttggcattgacagttgcagtatctgcaatgggatgcggcagtaaaaaaagcgactccgaagattcaacaaaagccaaaacagaaagcagcagtgaagaggaaaaaacagcagaagaagtggagacagacagcgacggacatgttgtggctgttgataccgatgatatcacaaaatatgtcacacttggagactataaaaatttaagtgtaaaagtaccaaaaacagaagtgacagatgacagcataagcgagtatattaatgagcagcttacttataaaccggaagaaatcacagaagaccgtgcggtacaggaaaatgataccgtaaatattgattataccggatatatggatggaaaagaattttctggaggttcagcgacagatactgaccttttaatcggttccggacagtttattgatggatttgaaagcggactgattggagcaaaaaaaggggatgaagtaacgttaaacttaaaattcccggatccatatcagaataatccggatttttcgggaaaagatgtacaatttaaagtaaaaattaataaaatctctcagccggcagagctgacagacgaatgggtgtctaataacagtgatgtgaaaacggttgatgaatacaaagcagaagtgaaagctaccctcgaaacaagtgcagatatggaatataataataataaaaaatcaaatctgtttgaagcgcttgtcaataaaacagaaatcagcgaatatccggatgatttaatggaagcagcaaaagaaaaagtggaaaaacaatttgaaaattattatgcaaaaccatcaggaatgacactggatgaatattggaagtctcagtctattacagaagaccaggcttcgcaatatattgaggctcaagcacagaccaatctgaaacaaaatatgattgtacaggctgtgcttgacgcagagggaattacctttacaaaagatgaatacagagaacagctggataaatttgcaaaagaatacggatttaaagatgcagaggcattagagcaggcatacacagatgctgagcttgtaaaagacaatgttttatggagcaaagtatgtgacattcttgaaaagtatggaacaattacagatgtagctgaagacgagacaaccgatgagacaacaacagattccaatacagcagagtcatccgattctacagagacaacagcagacggggaaacacagacagcgaattaagtggtaactctttccctcttttgcatatactaaaatgagtataggcaaaagggggatttttgttgcaaagaaaaagcgtaagggatgatttttatgaacaggagcggtatgcaaatcaggagttacgtcgtttccgtgcaaattatccagagaatgcggcattaatccagaactatgtggaggatgcctgtgaccggatggattatgagggcagtagaatgtacgatgaatatccggacaggtatatgctgaagaaaaactgtgcgtcgatttcaaaccggataaaaaaggacagcgagacgatgggagtggaagcaggatttgcgaaaaagtgtcagaatcttccaaaggaaactttagatgacttagttgaagtcttgttctataatgaggtgtatcgcagacggttgaggcgtcgcagaggaaaaagattttatccgtaacagacagggaaaatatttttgggacttgcgattttagagtaaagcttttacaatagagacaaatgccgtaatggtattttgtacagcgagtattaaaaagatacttgatttacgctgtatcaggcagactgcaatggatgcagtaaacaagtgtttagttaggagaaaacatgacggaactagcgggatttttagaaacttatgtaaatacgcagatgatacggattataataagcggccccagaaaaaaggaggggccgtctaaaatacagattcgtccgctgtcattaaagggagaaatcaaatttcaggaaactcagacagttggacaaaaagaacttcataaaaattatgagcaaaatgaaattatacagcggatgttagaatggatggaacattcttttaagcagttgcagttagagggacaagatatcgatgcgacggtactgataagtaagaagggaaaggcaaccattaaaataaaaaaaagccggacccccaaagagtttgtgccaatgctcgcccataatcgaaagaagaaatatctgctggaagaaggtcggccggttccttttttaattgaccttggcgtgatgagtgaagatggaaagataaaaaacgcaaggtatgataaattccggcagctcaatcgtttccttgaatttattgaggatatcttaccgaagcttccaaaagaaagggaagtgacgattcttgactttggatgtggaaaatcctatctgacttttgcaatgtaccattatcttcatgaattaaaacattatgatgtgcatattatcggactggatttaaagacggatgttattgaaaaatgcaatcgtcttgcagataagtatggctatgaaaaattgaatttttatcagggcgatattgcatcttatgaaggatgtgaacaggttgatatggtggtcaccctgcatgcatgcgatacggcaacggattatgcgttagaaaaagcggtaaggtggaatgcatcggtgatcctttctgtgccatgttgtcagcatgagttgaaccggcagataaagaatgaaatgctcgctccgattttagaatatggaattttaaaagagcggttttctgcgattttgacagatggactgcgtgcccagatgcttgaaagtaaaggatatgacacacagattcttgagtttattgatatggaacataccccgaaaaatctgttaattcgggcagtgaaaaatgagaacaagaagtacagtgaacagcagaaagcagcatgggaagcctgcatagaggcatttcatgtaaaaccaacgcttcaaaaagagctgttcttagaagggaatcataaataaatgaaaaaaatactgacgaaagcagggattcttctgttggtctttatacttggagtgataggcttcagcagtctgatgaataaagagaccacagataataagatggatcttgaagaagccacgttgcctgtgatgagcatgaaaataggaggtgaaaaagcgaaccttatgtatggacatgctgggcagatgcaggtggattttatgagggaaagtctgacaccgttagagacagacaaggaactcacagtcagcattacaccaaacggtcataaaataaaagatttggtttatgaagtccgtacatcagatggaagcaaagtcattgaaaatgataagataaaaaatttcaaaaaagatggcgaggataaaaaggttacattttcacttcagaaatcaatcttaatgaatcaggagtactcgcttgcgtttacactgacaacagatgagggagactactactactataccagaattttacagcgttccggattgaatacagagaaatatctgcaatttgcaaagcagttttctgaagatacgtttgattcagatgcacgttcagagattgtctcttatctggaatcagatgattcaacaagaaataacagctttctggatgtcaatattcattcgagtgtcagtatggttatgtggggagatttgaatccgtcggttctttctgaaggaattccggtcataaaagatatcaatggaacgactggaagtgtaactcttacttattacattacggcagacgacgatgataagaatcaggagctttatcaggtagaagaattttatcggatgcgctatgatggaagtaagatgtatcttttgaactttaaccggagtacaaaacaaatctttacaggtgattcaagcagtattgcaaacggaagagtgaatcttggtgtgacttccaaaaatgttcagtatgtggcaaataagacaggagaaatttttgcgtttgtacagcagggagatatctggtcttataacactgcgaccaataaattagtgcaggtgtttagtttccgtaaacaggatgcaattcaaaattttgatgcaagagaaaatatttctcagcatgattttaaaatcattcgtgtggaagaaagcggagatattgactttgtggtatacggatatatgaaccgtggagaacgggaaggtcagacaggaactgcagtttatcactattacagcgaccagaatgtattggaagaaaaagtatttattccaagtctgagttcctatgagtttatgaaacaggatgtgcaggtgctttcttatgtttctacagacaatatgctgtatttgtatcagcaaaaaaaattgtatcgcattaatctttcagaaaaaacttatgaagtggtaaaagatggaatcgacacacaatgtttctttacgtccaattccaaccgtcatattgcatggttagaagagatgaagttatttgattcttctaatattattgagttggatttggaaaccggtgaacagaagaaaattacggcttcggatggaacgagaattcgtgcgtttggatttatcaatgaagatttggtttatggcgtagcagatgaatcggatattaagacggattctacgggaagtttttattatgcgatgaatgagcttcggattcaaaactttgatggcgaactggtaaagagttatgctgaggatggtgtttatattacagatgtgaaaatttcgcagggcttgattgagctgtcaagagcgcagtggcagaacgaccattatgctgaaattacaagtgaccacattatgaacaatgtaaagacaaaagaagaagaggttgcgtcaatagcaacggttacgacaactcgtcaggcgggaattaccagattggtgtactcggacgaaaataaaaataaaaatccgcttgtctcagttccaaagtggatggtattggaagacagcacgacgctggaacttgatgagggaacggatgataccaattattattatgtgtatgcaaatggcgggctgtacggaatttatacggatgttgcaagtgccgtgcaggaagcagatgcacagacaggtgttgtgttaaatcgtgcacagcagtatgtctgggagcgtggaaatacaaagactaaagtgacattaaatgtcgctgagattccagactggtttaagagtgcaaagaccgatgtttcttatctggaagaacagttgggagatggcggaacagtgatgaatctgacaggatgtaccctggaagaagtgttatatcaggtcagtgcacagcgtccggtgattgtaagccttggagatgcaggaaatcgtgtgattgtaggatatgatgcatacaatactctactttataatccggcagaccagacaacatcttatatgggaattaatgacagtactgcagcatttgaggcagcaggcaacgtatttatcagttacattgaaaagaagattgaataaaaaaatgagaaaaattggggcaaaatattttgctccaatttttttgcaacaaaatggcattaaaaagacactataacaatatagaaagaaaagtacgtttggaaaagtaactgtaaaattgtaaaatcaaggataaagcacagaaaaattccgaaagtacattaaagagggaggagggaaaaaatggaggaaagtcgggagctggtaagacaggcaaaaaagggaaagagagaggcatttgcaaagctttatgaaacagtatacgaggatatgtaccgatttgcactttacgtgttaaaagacagggaagatgcagaggatgctgtggcagagactgtggcagatgcgtttgaatccattggaaaattgagaaaagaagaagcatttcgggcatggatttttcagattttatccaataaatgtaaacgaaagctaaaagaatatataacaaaaacctattcttatgaggaaagtgaacaaaggttagaaaaagacagcaaaacagaggatatagcacacgctattcacgtaagagatgcattttattctctggaagaagaggaacgttacatggtggcacttcaggtgtttggaggttataaaagtcgggagattgcagcacttttacataaaaatcataatacagtgcgttcacaagtaagccgggcattaaagaagatgaaagaaaaactggattaggaggtgcagtgatggcgaaaaaagaagaatatcataatttaaaagacctgcagtcagatgagctgaacctggaaaaagtaatagaaaagattcgggaagaagcaaaagaagaagaaattccagaacgcttgaaaccggaacatttagatgaaattttaaattcacagaaaaagaaaggcaggtggcaggggatgaaaaaaagaaaatatatggtagcagctgcatgggtggcagttttagtcggaattggagtttccagcgtagcacttattcataaaaaggattcggcagaaattggtgcacagacagcttcttcggcaaaagacggaagcggaaacagtaccatttcgcaggaagcttcagcagaagaaaagcaggtggaaggttataaatctgcttccagctatgaagaaatttatcagaaattatttgtagagacaaagcaggcacaggaaacacaggaggcatggtattcgagttcatcgaatattgatgaagattatggaattatgaaggaaagtgctgtggccgatggtacaacctcttcaatggcaaaagcggtttcagaagataatagttcagacagttattcccggacaaatgtgcggacagagggtgtagatgaaggggatttggtaaaaacagatggtacttatatttatacgttaactcgttcaggcagactgatgattacaaaggcagaaggaagcaaattagaaaaggcaggagaaacttctcttgaaagtatgacagacaccatcagtgacatgtatgtggatgggaatacggtttgcgtcgtagcctacggatatgacaccgatgtctcgatggaaggagaagatacttatgcggtcaattcgacaaattatacgaaactttacacttatgatgtatcagataaatcaaacatcgtattaaaaggaacaatcaagcaggaaggatattatgagacatcaagaaaagtaggaaattacatgtatctgttttctacctattatgcccaggaagaaaatgcgtctaaagaccatccggaacttttagtgccgaagattaatggagtgccaatacaggcttcggatgtattttgtccggtagagcctcagacagatacgactcagcttgtaatttcttctgtcaacttagaggaaccggataaagtgatggcaagtcgttctttaattggagctggtggaatgtattatgtcagccagaataatatctatgtttgcatgagtcaatatcagacacaggagataacaacacagattgcacgcttttcttatgcagatggagcgttggaattaaaagcagccggacagattaacggaacaattcatgacagtttttgtttggatgaaaataatggctatctcagggcagttgtgactcgctatccgaatggatggggtggacaggaaagtaatggattatatgtcctggatgaaaatatgaaagtcagtggaaaaatcgaagatcttgcatttggagaaagtattcagtctgcacgatttttaggagacaccggatattttgtgacttataaacaggtagatccgctgttttctgtggatttaaaagaccctgaaaatccaaaagtgattggagagttaaaggtgaccggattttccgagtatctgcatttttatggggaaaataaactgcttggaatcggacaggaaacggatccggacactggagaattaagaggaattaaattatccatgtttgatatttccaatcctgccgacgtaaaagaagtcgataaaattgtattaaaagatattgatgtttacagcccacaagataattataagagtgtgatgattgatgcagatgaaaatatcatcggatttgcaatgggctcttatgataaagtgacttataatctgaaggggtattatggagtttttggttattcagcagaagatggttttacgcaggaactgatgcagagtttaagtaaggcaaccggaaattcatccgacagctacaatgtaattgatgaaacaagaggaatttatattggcgataccttttatctgtgccagaatcagggaatctatgcatttgaccggagtgacggatacaaagaaatcggcaaacttgagtggtaaaattcccttgcgaagcctattacaatgcgttatacttatgtggagcgggtttcctgctccacttttttcattacattttgagaagtaataaaaaactggatacacagggatggaaataaaggagaacaaatttatgaaactgacaacagtaaaagagatttacaaaaacagagagcagtatcttgataaagaagttactgtaggcggatgggtgcgaagcgtacgtgattccaagacatttggctttattgtgcttcatgacggtagtttttttgaaacccttcaggtcgtttatcatgattccatggacaatttccaggatatcagtaaattaaatgtaggagcagccattattgtaaaaggtaatttagtagcaactccacaggcaaaacagccgtttgaaattcaggcagaagaaattatggtagaaggagaatcagcaggagattacccactgcagaaaaaacgtcattctctggaatacttaagaaccatttctcatctgcgtccaagaacgaatacgttccaggcagtatttcgtgtacgctccctgattgcttatgcaattcatcagtttttccaggagagaggattcgtctatgtacacactccattaatcacaggaagtgactgtgagggtgcgggagaaatgttccgtgttacaacattggatatggaaaatcttccaaaaacagaagatggaaagattgattacagcaaggacttcttcaaaaaagaaacaaaccttactgtaagtggtcagttaaatggagagacttatgcgcaggcatttagaaatatctacacatttggaccgactttccgtgcagaaaactccaacacaacccgtcatgcggcagagttctggatgattgagccggaaatggcatttgctgatttggatgataacatggcacttgcggagtctatgttaaaatatgtaatcggatacgtgttggaacatgcaccagaagaaatgaatttctttaattcttttattgataaaggtttattagaccgtctgaatcacgttatgacttcagaatttgcacatgtgacttacacagaagcaattgaaattctggaaaaagtaaacgacaagtttgaatacaaagtattctggggatgtgacctgcagaccgaacatgaacgttatctgaccgaacaggtctacaaacgtccggtattcgttacagattatccgaaggaaatcaaagcattctacatgaaacagaatgaagatggaaagacagtagcagctatggactgccttgtacctggaatcggtgaaatcatcggaggaagccagagagaggattcttatgaaaaattaaaagcaagaatggatgaactcggcttaaatgaagaagattacggattctaccttgacctgcgtaaatacggttctacccgtcattctggatttggtcttggatttgaacgctgcgttatgtacttaaccggtatgcagaatatccgtgacgtcattccgttcccaagaacagtaaataactgtgatttataaaatggtttgaatatgccattttatgggagtttgacatcataaaatcagatgaataaaaaaatcccggagcactaatatcagagtgctctgggatttttttgattattttttatttgccagatttgcgttatgttttgcaaggaagcggttgatccgttcaactggatttaacaatttgctgatagaagaatcatgatttaaggtatcaatgagtaaagcaatatatttactcatatcacagtttacatagtattctttctgaagcagttcttctgtctgataaaccagatttgtggtaagcagacggtcaaatgcacctttttcataagcttcatcaaattttttgagaccattggtgaacagtccaaaagtagcgcacataaagatttttgcagctcctttttcttttaataaagcagcaacttcaagcatactgtcaccggaagaaatcatatcgtcgatgataatcatatttttgccttttacgtcagcaccaaggaattcatgtgctacgataggattacgtccgtcaacaatagtggaataatcacgtcgtttgtagaacatacccatatcaacaccgagtacgttggcgagataaatagcacgtccggtaccaccggcatccgggctgattaccatcagtttgtcattgttgatttcaatgtccggttctgcacggaacagaccttttacaaactgataagctggctgaactgtttcaaacccatgaagcggaatagaattctgaacacgagggtcatgagcgtcaaaagtaatgatgttgtcaactcccatgtttactaattcctgaagtgcaagtgcacagtcaagagattcacgtccggtacgtttatgctggcgactctcataaaggaacggcataataacattgacacggcgagcttttcctgcgatggctgcaatcacacgttttaaatcctgaaaatggtcatccggagacatgtgattggtctgtccgcaaagtgagtaagtcagactgtagttgcaaacatctaccatgagatagatatcatcaccacgaacagattcttttaaaattccttttgcttctcctgagccaaaacgtggggtttctgcctgaattaaataagagtcgcgttcatagccttcaaactccaggttgttaaagtgagaatattctctgtctttacgccagtctacaatgtagtcgttgacccttgcgccaagagcagaacagctctttaacggaatgattccgaggcgtcctacaggaagtgaatctaaaggtgtggtatcttttggtgatggtgacattttttactttcctcctaatagttttttttggattcttatgtcatttccaattagtttgagcatggtgtaattactggatattctggagaagatacgttctgagtaagtttccagaaaattttccatggtcaggtttgttgatataatagtggatttatgattgataatgcgctcatttacacagaaaaacagctgactggcaacgaaagaatttacaagttccgtgccaaggtcgtcgatgattaataaatcacagtttgctatatattctgccatatctgaggcagcagtatcctttttaaatgtgttttttgccaacaggtcaaataaatcaaaagatgaaaaatataagacaaaataagacctttggattaattctttggcaatacagtgggaaagataggtttttcctacaccggtatcaccgtaaaagaaaatgccggcaggatggctggcaaaattatcaataaaatcccagcatttaaagtaagcatcccttgcggtttcaagtgcatttaagccggtagcgggattttttacttcctcagaataatattgaaacgtaaagttttcaaaattttctacttctaagatttcgcggatatttgactgtgtataaagtaagtcaacagccgccttgcgaaaacaggaacatttctgattatcgacatatccggtatccttacagtgcggacagtcatagtgaagttccagataatcagcgggaaagccgtttctaagaagcagtgtcctgcgttctttggagagtgtttcaatttcatcagagagattgaaatctgctgatgaagaaggcataagaagagccctggctttttttaaactaagggatgcaatttcgttgtcaatctcctgaagcctgggaatccttttataagcaatccggatacggtctcgctgttcatgtttatgttttaattgtttctggttatattggcgcataagtgcgtcgtattgtgagttatttagtgacacagtttttcctctttttatttgttcaacagcagtttttcaagttcattaacattatacgcacgctgatgaaagttattgaatttattgcgggaggcagatgactgagcacggggagccggagcctcgttttttgcagcctttgcctgtttatgagaatcttccagcttttccacatcggcaacatcatgaacagctcttttctgccagcttcttaaaattgagtcggcataaggaaaatttggctgaccggttgccatgactgccttgctgcaggcaagggaaataatttcaagagaaaatccaagttcgtcaagccatacattcatgtagcggatttcttcatcaatcggatttcggtttttaatcccaaacgcgcgcaaaatcgcaaagtaatttttgttgtatgcagtggttgccgcctttgcctgttcaatagttgtgatattctggtcagcccaggaaagtgctacggtttctatgtagcggatgctgtggctgccttttgatacacaatactcaatcaggtattccataaggtcggttgaaaaatgaagttcgtcataaaaatacaataatttattaatttcgattggagagagtgcttttccaagatactgttctgcaacaaaaagtatctgaataacatcttctcgttcggttaaagccctgattttttccgccgataaagaagacggctttgcaagttcatttgaaacagcttccgaaccggttggaatttcagtagaagttgaggctgtagaaactatatttgcagcactggttggagcctgcggaagatttgcgcccacaggaagcagacggacactgtttaaattgccttgttcgtccaattttaaatcaagcactcctgatttatgccagtattttaatgccctgagcacatcattttccgtacaattaaaaatgtcggcaatcgatgacagctcaagtgaagcggaaacgccggtggcatttcgtaagagataaagataaaccttaacgaattccccgtttgcctgtggcatacagacatcgaggaaatagttggagattaaagtgtaatctccgggaaaatcattacagagtgtaaactgtcccatttccaacatccttttctaatcaatctatgtccaaactcagtataacatagaatttttgaaaagagaataagcattttttgacaaaaaactctgcagacatttccttaaattagatattaggaatgcctgcagagtatataagttcttacagcccgagcagatgttctccgattttataaacatcgccggcgcccattgtaattaataagtcctgcggtacacagttttccagaaggaaatcttcgatttcgtcaaaagtagagaaataatgagcatctgttccaagtaaggaaattttttcctgaaggtctttggaagaaattcccagtgtatctgtttctcgtgccgcatagatatctgcaagcacaactttatctgcaaggcttaatgcctgggcaaactcatccatcagtgcttttgttctggtataggtatgaggctggaatacacaccagattgttttatgtggatagttttttgcagtgcgcagtgttgcggcaatctctgtcggatgatgtgcatagtcatcaataacggtaacacctcccacttttcctttatactggaaacggcggtctgttcctccaaaatgcaggagacctttctggatagattccagggaaagaccaagttttcttcccagtgcaatggcagacaatgcatttgagacattgtgaatgccaggaacggaaagtgaaaaatgaccaagtaaagtacctttttccatacaatcgaaggaagcgtgtgcagtttcatcaaattcaatatttgcagcagtgtaatctgcatcctgttccagggcataggaaataatttcgcatggtaaatcctttgtgatttcggcaacatttggaatatcctgattgataattaaagttccgtctttcggaagtttttcggcaaacaatcggaaagaatgacgaatatcatcaatatctttaaagaaatccagatggtcggcatcgatatttaagataatgctgattttcgggaaaaagcttaaaaagctgttcgtgtattcacaggcttctgtaacaaaggtttcagattcgccaacacggatatttccatggattgcaggtaagattcctccaacggaaatagtagggtcagcgtctgcttctaagagaatatgggaaatcatggaagttgtagttgtctttccgtgtgttccggaaacagcaattggagtttcatagttgcgcataatctgaccaagcagttctgctcttgtgagcattggaatctgtttttcttttgcacaggcaaattccggattatccggatgaatcgcagctgtgtagataacgagttcaatatcgtctgtgatattagaagcacgctgtccgatatagacttttgctcccagactttccaagtgcgttacaaggtcagaaggtttggcgtccgaaccggaaattttaaaatcttcttttaaaagaatttcggcaagaccactcatgctgattccgccgataccgataaaatgaatgtgtaatggtttattaaaatctatttcatacataaggcaacaagttcctttctatctttaattccttaacttttacatctttcaatagttcattatacataaaaaaaatgggaatgaaaaccctttcttaatcaaaacgttagagacaagtaaaatgtcacaaaaacaatggaaaagtcgaaaaaaaattgttaaaaatgttcacaattttgatttgatgtggtataatagaagaatcataaatatatacaagaggtgattacatgattaagaaagagatgattgccatgttgcttgcaggtggacagggcagccgtttgggtgtactgactgcaaaggtagcaaaaccggcagtttcgtttggaggaaaatatagaattatagatttcccgcttagtaactgtattaattcaggagtagatacagtcggagtactgacacagtatcagccacttcgcttaaatacacatatcgggattggtattccgtgggatttggataaaaatgtaggtggtgtttccattcttccgccttatgagaaaaaaacggatacagaatggtatacaggaacagcaaacgcaatttaccagaatatggcatatatggaaacctacaatccggattatgtattaatccttggtggtgaccatatttataaaatggattacgaagtaatgctcgatttccataaagcaaataaagctgacgtaacattagcttgcatgccggttccgtgggaagaagcaagccgttttggtctggcaattacagacgagacaggacgcatcacagaatttgaagaaaaaccggaaaatccaaagagcaatcttgcatctatgggtatttacatattcagctggccagtattaaaagaagccttacttgcattaaaagaccagccaggctgtgattttggtaaacatattctgccatactgcagagaaaaaggtcagcgtctgtttgcttatgaatataatggctactggaaagatgtaggtacacttggctcttactgggaagcaaatatggaactgattgatatcattcctgaatttaatttatacgaagaattttggaaaatctatacaaaaacagatattattccgcctcagtacatttcagcagaagctgttgtagaaagaagtatcatcggcgaaggcagtgaaattcacggtgaagtttataactctgttatcggacctggtgtagtgattaaaaaaggcagtgtagtgcgtaactctatcattatgaaacagtcctttatcggagagaatgtaacaattgataaggcaatcatcgcagaaaatgttacagttggaaataacgtagtaatgggtgttggagaagacgttccaaataaagaaaaaccaagtgtatactcttttggtttagtaacaattggagaaaattctgttattccggcagacgtaaaaatcggaattaacacagcaattgttggagagacaacaccggaagattatccggatggagaacttgcaagtggagaaactttaaataaggaaggtgagacagcatgagagcaataggaattattcttgccggcggcaataacaataaaatgaaagaattatcaaacaaacgagcaatagcagcaatgcctgttgccggaagtttccgcagtatcgactttgcgcttagtaatatgtcgaactcccgtattcagaaagtagcagttttaacacagtataatgcacgttctttaaatgaacatttaagttcttcgaaatggtgggactttggtagaaagcaggggggcttatatacattcccgccaaccattactgcagataataacttctggtacagaggaaccgccgatgcaatggctcagaacttaaatttcttaaaaaacagccatgagccttatgttgtaatcgcttccggtgattgtgtttataaaatggatttcaataaagttctggaattccatattgcaaaacgagcagatgttaccgttgtatgtacggatgttccggctgatgaagcaaccagatttggctgtatcaaaatgaatgaagactgcagaattcaggaatttgaagaaaaaccgatggtaacacataccaacacggtttctaccggtatctatgttatcagaagacgtcagttaatcgagctgcttgaaaaatgccaggaagaagacagatatgatttcgtaaaagatattctgattcgttataaagaattaaagagaatctatggatataaaattaatacatactggagcaatatctccactgtagatgcttattatagaacaaatatggattttctgaagccggaagtcagagattacttctttaatcagtatccatccattcagtctaagattgatgatttaccaccggcaaaatacaatccaggttcacaggtgaaaaacagcctgatttccagtggatgtatcattaacggacaggtagaaaattctatcttatttaaaaaagtatttgtgggtaataactgtgtaatcaagaactctatcattttgaatgatgtttatttaggtgataacacacacattgaaaactgtattgtggaaagtcgtgataccattcgtgcaaattcttactattgcggagaagaaggcatcaagattgtaattgagaaaaacgaaagatatgtattgtaatgactaagcaggtttttacaaaataaaagatacaaaaatcggacttataaagagggctttttgagaaggctatgaaaggggaagggtttattatgaacatcacagatgtaagagtaagaagagttgcaaaagaaggtaaaatgaaggcagttgtatccatcacaattgatgaagaatttgtagtacatgacatcaaggtgattgagggtgaaaaaggattgtttatcgcaatgccgagcagaaaagcgactgatggcgaatatagagatatcgctcatccgattaactctgaaacacgtgaaaaaatccagggaattattcttcagaaatatgagcaggtacttgcagaagaaccggtggaagcagaacagcctgcagaataaaaagaataagagcgaaaatgaaattaaacggtatgtctgtagttgcaggcataccgtttttgctatataatgcttcaaagaataaatactgtaaaggaaataaaactatgattgaacaattgccaaaggcatttttagagcgtatgaaagccatgcttggagaagaatacgaagattttttaaaaagttatgaagctccccgccagtttggtctgcgaatcaatacgctgaaaatatctgtagaagaatttttaaaacagtctccatttcatctaactaaagttccgtggacagagaatggattttattatgaagaagctgaccgtcctgccagacacccttactatgcctccggactttattatcttcaagagccgagtgcaatggcgcctgctgctattttaccggttgctccgggggactatgtattggatttatgtgctgcaccgggcgggaaggcaacggaacttggcgcacgcttaaaagggcagggcatgctggttgcaaatgaaatcagtgcctcaagagcaaaagccctgcttagaaatattgagctttgtggaattaaaaattcatttatcacaaatgaagttcccaaaaatcttgcccgtgtgatgccggaattttttgataaagttttagtcgatgcaccatgttcaggtgagggaatgttccgaaaagatatggacgttgcaaaaacatgggatgagagtcgtccggaattttttgcaaatctgcaaagagaaatcgtttcaaatgcgatttccatgctaaaaccaggtggactcatgctgtattccacctgcacctttgcgccaatcgaaaatgaaggaacaatttcgtatatccttgaaaatttcccggagatggaacttttggaaattccggcttatgaaggattttcagagggaaatccagaatggggaaatggagacgacaccttaaaaagatgtgtgcgtattttcccgcataagatggcaggagaagggcattttattgcactgttgaagaaaaaaggaattctgtatccatccaagtccgatgtggcagtccagaaaccggaaaaagaagcatggaaattattaaatgaattctgggcgccaatggaacttccatttgaaaaagaacggattgaaatccgcaatcaaaatgtatattatctgccgccggcatcgaatcactataaaggaatccattttgtccgaaatggtttattcttaggagaattaaagaaaaaccgctttgagccatccgaaccactggcgcttgcgctctcacaagaccagtttcctgcaattctgaacctttcgagtgaagaggaacgggttgcacgttatttaagaggagagacacttttaatcgaagatggcgaagcaaaagtgaaaaagggctggcagttagtatgtgtggatggacatccgcttgggtttggaaaactggtgaatcagactttgaaaaataaatatccggcagggtggagaagaaattcgtaaagaaattgaaaaaggattggaaattgaatgcttatctgcgttcaatttccaatccttaaaaaataaaagaaaaacggtacgacatttctgccctaccgtttcttcgttgaagtcgaagcgacgtgattcgaacacgcgacctctgcgtcccgaacgcagcgctctaccaaactgagccacgcttcgttaaaatgtttttcgcattcaacatttgcaattatactggaattgaatcaaattgtcaataaaaaaatgaaaatttttaatttttttttcatatacttttgacatttgcatcatatacttttaaagaacaaattttttggagaattacatgtctggatatcgacgatttattgcttatgtatatgaatatgagggaagaaaaaaaggaaatggaaaaggatttataaaagttgaagttcgggatggagtctgccggatgcagtttcggctgtcaggtgtttatggacaggaaactcttccatgtgaaatttatggatatgtaagagaggaagaaaaacaggaatgtgaagcagtttatcttggaacttgtgatttggcaggagaaattattgccttttcactggaactaacaggagaaaatgtctcggaaagtggatattcaatcgatgatttcaatggaatcgtgtttttagccggtgatgtgatgtatggaaccggctgggatgaaaatccggtgtgtctcgatgaaattcggtttggaaagaaaaaagaagaaaatggagaagagatagaagaattaaaagaagaacctgaagaaacagaaggtgaagaggaaggcagagaagaaacagaactggaaatacaggaaaatccatttccaccgacaccaagtatcttagaagaagtcggagaggaatgtcaggaagaaataagtgaaacaggagaaatagaagaaaaattagaggaaccagaagagccggaggaatcaggagcgttagaagaaccggaagaatcaagtgaactcgaagaatccttctactgtccatttaaggacggcgaatttgaacagtgtgcaaaaattggtcttttggattataatcagctaaatccatgtgaccagggacttttaaataataatttcctgcgttatggatggagacggtataaacatgccttgattggaaaagatacgaagagaaattgttacatacttggagtgccgggaacgtataacagacaggaagcactgatggcgggaatgtttggattcccttattttaaagaagcaaaatgcgaaacaaccgaaatgtctgcacaggaagtacaaggacatttcggttattggtatcggtcaatcaatccccctgatggaaacagagggaatcgttcttaataaaatcttttgaaattgttctaattcggtttttgtataactggtgaatccgggatgaatcacatccggagaatcgcggtatgcctgtaagaaataggcctgacatccggcaatccacttaccgatagattcaaaatcggctttgtcatgaagttcacgtacaacggtagtacgaaattcgtaaggaatcacattagagagcagaaattcaacagattcacagatggatgttaaatcaatgtttttgcagccagatacttttgcataagattctttggaagatttaatatccattgcaaccatgtcaatcatctgattgttcactaatttttttagagtccatggatggctgccgttggtatcaagtttaactggataaccaagttctttgattttatcaatcaacagaaacaagtctttatccaaagtcggctcaccgcctgtgatgcagaccccctctaaaattccctgacgtttttttaaaacagaaaggacttcttctgtgaaaatcacaggctgtttatttggagagagtacgagagaactgttctggcaaaatggacagcggaaattgcacccgccaaggaagatggtggatgcaatttttccggggtaatctaaaagtgtggttttgttaaatccgttgattggcatggtggaaatcctttcttgctttagggatgataattcgggctaatttccgtgtccctcttttgaaaaacgttcattatattcactcagaggaatgaacgtgtcactctgttttgcctgatttgcatgataaaagagaaaacctgcaccaatcaggataagtaaaataattgcaaaaattatgtttctggtttttgtcatgggcattctcctctctaaaatttgaacgcagataagcattcccccgcttcaagtgcgtagagcactaagcggcgagtgagcactttacatcacgttttttatatctaataaaattatactattttattagaatgtggtcaataaaatagattttttgcttgaccaaaagcaggaagcaccgtataatagaaaaacatggagatgtactcaagtggtcgtaagaggtcgcactcgaaatgcgataggtccttcgtgggcgcgtgggttcgactcccaccatctccggtgaatggcggtatgacgaaagttgtactgccttttttgttgcgaaaaaattcttgcgaataaaaaaagtgccggtacattttcatgtaccggcaaagagagggagggaaaagaaaaatctatataaaaagttaacttgcttattgggtgaaggccggcagccacaaagttgatttcgttcaaaccttactttcgtaaaacccaaactgcgatgcagccgctgtcttcttcatttgataatgctagtatatcccaaaaatatgatagaattgtgtccgtatcataaaccttttctgaaatttttaaacagagtatgaaaaaaataaaaagcaaccggttgcaatgggttgcaatgaaaaagcactctgttgtataattctaaatcatacagaaataggatgcggagaatgagagacgaagaaaaatttatgaaagaggccattcggcaggcgaaaaaggcgtatgcgcttcgagaagtaccgattggttgtgtgattgtctatgaagggaagattattgcccgtggttacaatcggagaaatacagataaaaataccacttctcatgcggaaatcaatgcaattcgaaaagcaagtaaaaaattaggtgactggagactggagggttgtacattatatgtgacccttgagccatgccagatgtgtgccggagcaattgtgcaggcaagaattgataaagttgtgattggaagcatgaatccaaaagcgggctgtgcaggctcggtcttgaatcttttggaaatggatggatttaatcataaggtagaagtggaaagaggagttcttgaagaagaatgcagtaccatgctgagtggattttttaaagaactaagaatggaaaaggcaaaagcgaaagcaaaagcaaaggagctggaagaaaatgacaaaacaggaatttaaagaactggtagcaaaaggaaaagtggtattagatggagcaacaggctctaatttgatgaaagcaggaatgccaagaggtgtgtgttcagaagcatggatttatgaaaatccacaggcattaatagaattacagaaagcctatgcagaggcaggttctgatattatttatgcgccgacattttctgcaaacagaatcagtctggcaaatcatggattagaggataaagtagaagagttaaatcgaggactcgtaaagattacaaaggatgcagtgggagacaaatgtcttgtagcaggagatgtgacaacgacaggaaagcaggaaattgcttacgaagaactgttagaggcttataccgagcagattcgcattttaaatgatgcaggggtggatttactggttgcagaaaccatgcttggagttacagaagtaatggcagtattagatgcggcagcagcagtctgtgacctgccggttatgtgtactcttaccgtagaatccgatggaagtctgttctttggtggagatatctatgaagcagtagaaagtctggaacagatgggtgcagatgcagttggaatcaactgttcaaccggaccggaccagttagtatcggttgtggaaaacatcagaaaacgagtacagattccggtgattgtaaaaccaaatgcgggtatgccggcaattgatgaaaaaggcaatgcggtctactcgatgggcgcagaggcatttgcaaaaaatatgaaagtattgatggatgcaggcgcagatattgtaggtggatgctgtggaacgactccggaatttattaaagcattaaaaaaagaaatctagaaaagaaaaatgataatcaggtaaaaaggcacttccggaaagattcatttctggaagcgtttttttatgtaaaagaaaattccaatgagagtgaaagcacaaagtacaagttttcctgcctgattataagagtggaaatattgtgccgtcttttgccaggaagcaccggcaaatgctccaagtgtgacgagtacggtattccagatgagacttccgaaggtggtgagaataaaaaatttggaaaaatgcatgtgcgccatacctgcgggaattgaaatcaggcttcttacaattggaataaaccggcagaaaaagacggtataatttcctttgctgtcgaaccattccacggcatgagagacatcctcttttttaaagtgaagcagctttccaagtctgccctctacaattgcttcaagtttgaaaaccggaacaagacttccaatctgataaagcacaactgcgccaaggacactgccaagtgtagaaaaaagaataaccccaatcagattcatatttgtataagtagttagaaatccaccaaaggtcagaattacttctgaaggaatcggaggaaacagattttcaatcagaatcaagagggcaattcccagatacccataatgattcatgatagaaatcatccaatattgcaataaaaaaacctcccctgcaatcatctcttttattctatgatgatacaaagaaggttatgatattctttttttaccgtgcaccgcccatcgagactccttcacggacgttacctctacagttaactcagcccaggcaccctcacggcacacaggggattctgcttagtgctgcttcattcctgacctgacacggttcacagagtcctgttgcgtgagacccaaacgtcaacgccacttatagagggcagccccgcaaagcaagcccctccgtttggcaacacccctgctgtagcggattgcaggtacagggcaccgctaactccccggctgcacggtgataccagtatatcggttttttgcaggtttgtcaatgtaaaaaagaaaagcagagagaactttttggaaaattttaagaaagtgggaataaattagtaatgggaggataaaagtatgtgcgcaaaacttttgttattactattactcgggattttttttgcaggattttctaaagaagaagcagccaaagaagatgcagggattccgaaatttattgtgacggaacaggaatttccgaagtttaatgatttaaaagcaaaagagagtaaaagtcaggtgttttctatctggaatcagacagaagagacggagtgttattatttttggggacaggcaccaaacgatgtagagattgaactgaaaaagaaaggggatttattttataaggggaaaatgccggagaaaaaaatagaactgacaacgttaaatccaggggaaaatatggtatttgaggtaaccgttttaaaagaaaaaaatgaatcgggagaggtggaactgttttttcaaaattcgcattgtgataaaaaataaattagtatataataaaaaatgacaagatcaaaatatcaaaatgctattcgtgtatgtacgataaggtgtttgaaagtaagacttgtaaaaacacaagatgggatgtgatgaatctatgaagcgaattggtctgctgacaagcggcggtgactgtcaggcgttaaatgctacaatgcgtggcgtggtaaaaggtttattcaataatttagaggatttggaagtttatggatttgatgatggatataaagggcttatctacggaaattacagaatgctttctgcgaaggacttttcaggaattttaacacgaggcggaacgatacttggaacatcacgtcaaccgtttaaactcatgagagtaccagatgcaaatggactggataaagtagaagcaatgaaacagacttatcataaacttcgtctggactgtctggttattcttggaggaaacggtacacaaaaaaccgcaaatctgttaagagaagaaggactcaatattattcatcttccgaaaaccattgacaatgatatctggggaaccgatatgacatttggctttcaaagtgcagtcaatattgcaacagatgcaatcgactgtattcacacaacagcggcttctcatagtcgtgtatttattgtggaagtcatgggacataaagttggatggctgacccttcatgcaggtattgcaggtggagcagatattattctgattcctgagattccttatgatattcaaaaaatcgctgaggcagtaaaaaatcgaagtcgttccggaaagggatttactattcttgctgtggcagagggggcaatttcaaaagaagatgcagcactttcgaagaaagaattaaaaaagaaacaggaagaagaaaagaaagtttatccgtctgttgcgtataagctggaatcagaactgaaaaaggaactggatttggatattcgtatcacaattccaggtcatacacaaagaggaggaagtccgtgtccttatgaccgtgtgctttcaacacgtatgggttctgcagcagcaggattgattctgaaagaggaatatggctatatggtaggaattgtaaacggaaaaattaaaaaagttccgcttgcagactgtgccggaaaattaaaaatggtttctccggatgaccagttagttaaagctgcaaaacgaatcggaatcagttttggagagtaatcgaattaagcagtcaggcggactaaaaatatccgcttgacgagcatgcatcattcgcatggaaaagcaagaaaacaggagaagaattaaaatgagctatgttgcgctgtatcgcaagtttcgaccgcaaaattttgaagacgtaaagggacaggagcacatcgtaactacattaaaaaatcagataaaggcggatcgtatcggtcacgcttatctgttttgtggaaccagaggtaccggtaaaaccacgattgcgaaaattttagcaaaggcagtaaactgtgagcatccggtagacggaagtccctgtaatgaatgtgaaacctgcaaagcgatttcggccggtacttctatgaatgtaattgaaattgatgccgcatcgaataacggtgtcgataatattcgtgagattcgcgaagaagtggcatatcgtccggccgagggtcgttataaagtatacatcattgatgaggttcatatgttgtcaaccggagcatttaatgctcttttaaagacgctggaagaacctccttcttatgttatctttattctggcaacaaccgaagcacataaaattccaatcaccattttatcaagatgccagcgttatgatttcaggagaattacggttgatacgatttctgaaagactgagtgaattgatggaaaaagaaggtacggaagttgaagaaaaagcaatccgctatattgcaaaagcagcagatggctcgatgcgagatgctttatctttattggatcagtgtattgcattttatctgggcgaaaagctgacgtatgaaaaagcactcgatgtgctgggtgcagtagatatggaagtattcagtgaactgttaagaaaggtgttagcacaggataccgcaggctcaattaaaacactggaagagttgatagtgcagggaagagaactgggacagtttgtaaatgattttgtgtggtatatgcgaaatctgttgttggtaaaaacttcggatgtaccggaagatgctgtggatgtctcggcagaaaatctggaacgtttaaaagaagagagtgaaatgcttgacacggagacgctgatgcgttatattcgtgttttctcggaactttccaatcagattcggtatgcgtcccaaaagcgcgtattggttgagattgcactgattaaattatgccagccggtgatggagacaaatttggattctttatttgaccggattcgcgtactcgaagaaaagatggaaaaagggattccggttttgacggagtctcaaaaagcgagtactcgggcactgccgcagccggaactgtttggcgaagaagctcaagaccaggaagcagtaaaaccacaaaaagcagcgccggaggatttgcagtatattcagaaaaactggactgcaattgtaagagaaacaagtggtctgttaaaacagatgttaaaagaagctacaccaaagtataatgcaaacagtgatgagccaattctttatattgaatttcacaattttcaggcggaaatctgtaccaaaaatccagataccattccgcttctgaaaaaaattattcgagaaaaaacaggaaaagaagtagaaattcagtttgtgattacgaatacggatttaaaaggtccggcaggacttacaccgatttcggtagatgaactgattgaacaaagcatccagatggatgtcgtagtagaagatatgagtgatgacgaggaggacatataatggcaaaaagaggtggatttccgggaatgggtatgcctggaaacatgaataatttaatgaaacaggcacagaaaatgcagcgtcaggcagaagaaaaccagaaagctctggaagaaaaagaatttacggcaaaagccggtggtggtgcagtagaagtaacaatttccggaaaaaaagaagtgacaaaagtaaaacttgcagaagaagtagtagatccggatgatattgagatgttggaagatttgattgtagcagcaaccaatgaagcgttaagaaaagtagagcaggaatctgctgcaatgatgtccaaactgacaggtggtcttggcggacttggtggcggactgttctaagttttagatactctggtaacttagttgccgagtagttcacgaaaatcaaaagacagaggaatcaaattggaatattacagcagtcatattaacaaactgatagaagaattttccagacttcctggaatcggagcaaaatctgcccagcgtctggcatttcatattttgaatctgccgaaagaacaggtggaagaactctcttcagcaattgtagatgcaaaagccaatgtctgttattgtaaggaatgttatactttaactgaccaggaaatctgtccgatttgcaggaatgaaaaacgcaatcatcatatcattatggtggttgaaaatacaagagatttggcagcttatgaaaagaccggaaaatttgacggggtatatcatgtgcttcatggtgctatttctcctatgcttggaatcggaccggatgacattaagttaaaagagttgcttcagcgtctcacaagagaagaaattgaagaggttattattgccacaaattcaagtgtagagggagagacaacggcaatgtatctgagtaagctgattaagccgaccggaattaaagtcagccggattgcaagcggtgtgccggtaggcggagacttggaatacattgacgaagtaactcttttgcgggcacttgagggcagagtggaattgtaggggtgtaattttatgaggaaaaaagttacatcaacagatatcgcaaaaaaagccggtgtctctcaggcaacggtttcgatggtattaaatcataaatataatgtttctttttcaaaagaaacagtggaaaaaattgagcggattgctaaggaaatgggatatacaatcccaaaacggcgccaaagaaaggagagccggaaagggaagctgattattgtattttgtccaacccttaccaatccgtattatgtcatgctgcttcagggaattgaggcagtggcgaaagaagagggatacagtgtttttacctgtaatacacaaagagaattgaaactcgaagaacaatatctcaagctgatgtcgagtgtagaccctgcaggaattatatatacctgtaatccaagttctgtatttatggaacaggtaggcgagattgcaaagaaaatcccgcttgtaattatcagtaacagggagaaagtacaggttgatgcaattaatcaggataatacaaaggtaggacgtttgatggcaagacatcttttggattatggccacagagatgttgcatttattacacctccgcttacccaacgtcagaagcagcgttccaaacgagtacagggatttgtacaggagtatgagcaggcaggacttggagaccgagttgtgataaaagcggccgatgcgtctttggatgaacagttgccgagtccggattcggaatataagatgggatataatctgacaaaagaacttcttgcagaatatgataatctgacagcgattgcgggattaaatgacatgatggcatttggaatcatggatgcactgcaggaagaaaaatataaaattccgggagatatgtctgtaattggatgtgataatatcatcttttcgggcatgtctcatttgtcgcttactacaattgaacatttcgttccattaaaaggcagggatgcatgtgatattattatccgaaagattaaatcatcaaaagatacttatgatggaacgaatccaatcagtatttatcacatcgagtatgaacccaaattaattgccagaaaaaccacttcttatgcacgggaaaaacgcacgaaagaggcaggaaagaaaagaaatattaaataaaatcagaaaagatattagtaataaaaaaacaaaaaaaggctgtatatagcagaaaaattatgaaatacagccgaaaaattattaataaaatgcatatttataaatgaataaaatcactaataatttttttgtgacttgcccgtaaacgaattatgaggtaaactataaccaacaaataaaacgaacgtttcacgggaggaaatgagttatgaaattttttattgatactgcaaatgtagaggatattcgtaaagcaaatgatatgggaattatctgtggagttactacaaacccatccctgattgcaaaagaaggacgtgactttaatcaggttatcaaagaaatcgcttctatcgtagacggaccaatcagcggtgaagtaaaagctacaacaacagatgcagaaggaatgattaaagaaggtcgcgaaatcgcagcaattcatccaaacatgattgttaaaattcctatgacaacagaaggcttaaaagcagttaaagttctgacagcagaaggaatcaaaacaaacgtaacattaatcttctctgcaaaccaggcattactggcagcaagagcaggagcaacttatgtatctccattcctcggaagactggatgatatttctgtatgtggaacagatttaatccgtgacatcgttgagatatttgaagttgccggtattgatacagaaatcatcgcagcaagtgttcgtcatccaatgcatgtaacagaatgtgcacttgcaggtgctgatatcgcaacagttccatacaaagtattagagcagatgacccatcatccacttactgaccagggtattgaaaaattccaaaaagattatcttgcagtattcggaaaataaaggtaagatgtgagtggcaaaacaaaattgccactcacttatattatgagaaattttttcaggaggaaactatgaacaaattagagcttcagaaaacagccaatgaagtccgcaaaggtattgtgacagctgttcattccgcaaaagcgggacatccgggcggttctttatcagcagcagatttatttacttatttatattttgaggaaatgaatattgacccgaaagagccaaagaaagcagaccgtgaccgttttgtattatccaaaggacatacggcaccgggactttatgctactcttgcaaacagaggatatttcccggtagaggatttaaaaactctgcgtcatatcggttcttaccttcagggacatccggatatgaaacacattccaggtgttgatatgtccagtggttctttaggacagggaatctcagcagcagttggaatggctttagccggaaaaatggacaatgcggattaccgtgtttatacattgcttggtgatggtgaaatccaggaagggcaggtttgggaggcttctatgtttgccggacacagaaaactggataacttagttgtaatcgtagataacaatggacttcagattgacggtaaaattgaagatgtttgttctccatatccaattgataagaaatttgaagcattcaattttcatgtaatcaatgtagaagatggaaatgattttgaccagcttgcagctgcatttaaagaagcaaaagaaacaaaaggcatgccgacagctattatcatgaagactgtaaaaggaaaaggcgtttcctatatggaaaacaatgcaggatggcatggaaaagctccaaacgatgaagaatatgcaatcgcaatggcagacttggaaaaggtaggtgaagcattatgtcagaagtaaagaaaattgcaaccagagaaagttatggtaacgcattagttgaattaggaaaaaaatacgaaaatttagtagttcttgatgctgacctggcaggtgctacaaagaccggaatattccaaaaagcatatccggaacgtcacattgactgtggtatcgcagaatccaatatgatgggaatcgcagcaggtctgtctacaacaggaaaagttccatttgcaagtacatttgcaatgtttgcagcaggacgtgcttacgagcaggtgcgtaactccatcggttatccacatttaaatgtaaaaattggtgcaactcatgccggaatctctgttggagaagatggtgcaactcatcagtgtaacgaagatatggcgcttatgagaaccattccgggcatggtaatcttaaatccatctgatgatgtagaggcaaaagcagctgtagaagcagcttaccttcatgaaggtcctgtttatttacgttttggacgtctggcagtgccggttatcaatgacagaccggattataagtttgaaatcggaaaaggtatcgtgcttagagaaggaaaagatgttacaatctttgcaacaggtctttgcgtaagtgaaactttagcagcagcagaaaaactggctgaggatggaattgatgcaaaagtaatcaatattcatactatcaaaccattagatgaagaactggttgtaaaagctgcaaaagaaacaggcaaagtcgttacagtagaagaacattctgtaatcggtggtcttggcggtgcagtagcggaagtgttaagcgaaaaagctccgacacagatgcttcgtatcggtatcaatgatgtatttggtgagtccggcccggcagtaaaattactggaaaaatatggaattgatgcagcaggaatttacaataaagtaaaagcattcgttaaataattatatttacaaataaaaagctctgttatagaatagggctaagtcttagaggtgtcgccaaaaggcggcacctttttttagttcttatggctaaagtttttaagaactaaaaaagaaagggaatgaagttatgaaaacgagaagcagaagaacggtaaaaaatacaagaaacacaggcggagaggtcagacaggataaaaaatccgaaaatgaagaattttatggatatatcaaagatttggtacatcatccgtatgtcctgaaaatgaaaaattatcagcatcattgtaatacaagttgttatcagcattgtctgaatgttgcctattacaattataaaatatgtaaattttttaatctggatgcacgttctgcagcaagagcaggtatgcttcatgatttatttttatacgactggcataatcatcgcaaaaaaacaggtgaccctgttcatgcaatgacgcatccgcatactgccctgcataatgcgcaaaaatactttaaattaaatgcacttgaaaaagaaatgattttaaaacacatgtttcctgtaactccgattccaccaatgcataaagaaacgtggattatcacattaacggataagtactgtggaacatgtgaaatcggacagtattattttcatgtatggtttccgagaggtgtctatcacgcaatgaaacacctgatgaaaaaaatatttggcaaggactatacttatgcagattaccggcttccgttcggagaattctccgaagatgctgcagacagaggggtaaattttgcaaagcttcgaaaacgttcggaatctgaatccgaatggaaaaaatccaataaagaaaaacgatgtgttccgaaatattgacggtgtgcaatcagaatgccggatacaattgtgtctgcaagctgaatcacggttgcaagtcttgttgtctgaagtacaaaatgttcaaatgcccctgagaggtttacaattccagtgatggaaatgtcgccgaccgggggcagtttcttttttacaccaagtccgggggcaagtgcaccttttcggatggtgacaaattcctgatgtcgttttgagccaagggaggcatcaattgcaatcaaaagacagttcggatgttttgcatgaaccattgctgtgacttcagcaaggtttaaggcatgaacgggctgatccagtgtcccataaatgatacagcgggaaagatgttctttacttaatttatgtccgattaacggaccaaggctgtctcctgtaatccggtcacttccaatgcagagaaagactacttcctgaaaatctttttgctgtgagcacagcatttcaaataaaagagaaccgacctggttgggagcgcggcagcttttgctttctacatagtggacaggagcattttggtatgattccataaaatttaccatcctttcaaaaaaatcactgttttagtacagcgaatattaagtaactgctagattgacgctgtactactggtcaaaatttcttttataataggtttccctgttttggatgatttatcctgactttttaagtaaagatttgtcgacaaaaaaaatcaggcagcttcctcaaagtgataaaatttgcagagcttgtatgctattcttttgcccaaaggggtgaaagaattatgatagaggtcatttatgaaaaggagaaagaaaaagcggagggaaatcaggcttttttccggattccaaacaatatacgacagattggtgaaatacagggaaatcaaaaaatctatatagaagattatgcttatacttatctttgtagaatcgcaagtgaggattctgcaaaagggagagcggcaattctgcttgggcaggcgaactggaaagatggaaagacgtatttatttattaaaagtgcggttgcgcttcatgatattgaggtttcagaagaacattttgcctttacaaaggatgtgtggaaacagatttatgaggaaaataaaaaattctttccgaatcaggaaattgtaggctggtttttatcgcttccaggctgttctatggaacttcatgagggaatcagcaaaacacattttaatcattttggcggaaatgaaaaagtgcttatggtgatggaacctcttgaaaaagaagaggctttttatcgttatgaagaggggaaacttaccaggcaggaaggcttttatgtttattatgaaaaaaatgagccaatgcaaaattttttaattgagcaaaataaatatgcaagagaaagaagcgaaaaggtagcggatgaagcagtaaagacatttcgtaaaaaagtagaagaaaagacgaaaggaaaaaagcgggataaaatagcgcctctgtttcggatggcaagtgcaagtgcggcagcagcaatgttgattgcgggagtactttatctgaatcaatatgagaagttaaaaaaaacgaattctattgcagacaaagcaaaaattgaaaaaaagaaatccgaaacggttgtgtcaaattcaaacaacgatgcagaaacgatagaaaaatcagagacttccgatacagaaaagttaaaagaagagacacagactgggacagagtcggattcagtatcaggttcaatggacggtaaaagagataagaaatcagaacaggcaaatgcaggggcggaagggaacaagcagagcgaatctgcaagacaggaacaacagggagagacagattcagataggacagaaagtgcaaatacagcacagggcacaggaaatacaagtatagcgcaaaccacaggttcaaattcaatgcatgaaacatataccgtgcgtgagggggataccattaccagcatcagccgggcttattatgggacaacttcaaaaataaaagagatttgtgaattgaatggaattttcgcagaagaatttatttttccgggacaaaaaattttactcccgtagaaaagtgtgctataatagccgcatgtcagggcataagcgctttgatataaatagtggactcacaaaatcaagcacagaaagattctgagagtacataataaaacaaaggttaagataaatggaacagaataaagaaaaacaaagtcaaagcaaaagcaagggtaagaaacaaacaagacaaaccagagaacaacgcagacaattagagatgattttagtaggcattttgattttaattgtaattattgtaatagctgtattagttattcacaggcgtacgtatcacaactattctgtactttcgtcttcaaaaaatgaaaatgtgcaggcttatggttttgtccagtttgaagatgaaattttgaaatacggaacagatggagtttctttggtaaatcaaaaagaggaaacggtatggtcagaggattttcagatgacaaatccgacagtagacgtctgtgaaaacatggcggtggtagcagacaaggatgcgacttctctgtatattttatcaaaagaaaaagtggttggaacggttcagacatccaagccgattttaaaagcaagagtggcgagaacaggagttgttgctgcaattttacaggataatgacaaaacatgggtagatttttatgccaaagatggcagtctgattgcggaaaaccagacaagaattgacagtccgggatatccggttgacattgcagtatcaccaaatggaaagattattatggtcagctatctttatgtagaagatgcgcagacaaccagttatgtagctttttataattttggagacagcggtcaaagtgaaattgacaatattgtatccggttacacttataaagatgtcattgtaccgcagaccatttatttaaaagacggttctgcgctggcatttcgagataatggattttctgtctatcagggagaaaacattccgaaagaagagaaaaatgtggaaatgacatcagagattgtcagtacattctataatgataattatgcaggagtggtattcaaagataaagataataataaaaattatgtaatgcgggtatacagtctgaatggaaaaatgaaatttgaaaagaagttcaatattgaatatacccagataaaaatcagcaatgaaatgattattatgaataacgatacgcaagtttgtatgattgacttaaacggaaacaaaaagtttgatggaaactttggagaggggacaatacaggggattttcagaattgcatccaatcgttatatggtggtttcggaaagtggaatcaagacaattaaattaaaataaaatatgtggaaacaggcggttgtcggcaggcaatggtctgttttctctgcattatgggatagatttaagcgtagcgtttaaaatatggaaacagaatggtatttaagtaagaggctcggttccttatagtcgggtagctcacgaaaaaatcaaggaaagaaacaaaaggagaaaagcgtatgaactggttaagcatagtaattttagtgatactggcagggtgtattttaaatggttttagaaaaggaatggttcggacactggcagcaatgatgtcgcttgttgtgagtctggtgctggtatcactggtaaatccttatgttgcaacatttctggaagaaaaaacaacggtgtatgaagtaactgaaaccaaatgcagggaagcatttcaaagtattgccgaaaaacagacggaaaatgtgcagcaggaatttatgcagaaaatgggtgttccggaaaatttttcaaatacacttagaatcggagatgagtttacggaaagtgcagtggctccacttgcagagtcaacggcacatctgattgtaaatggacttgcttttgtgattacatttgtgctgttatcgattttgcttcggattgcagtggggctgctggatggtttattcagactgccggtcttaagcatggtcaatcgtcttgcaggtggggcaataggcgcagttcagggattggtgattttatgggtattctttttgattgtgtttctaatctggaatacagaaatcggagcacaggcattggcaatgattcaggaaaatctagttataaactggctgtataactgtaatccgtttgtaaatattttattgaaataaaaagaaagaagaaagctatggtaaggataaaagatattgcaaaagaagcgggagtcagtccgaccactgtttcgaatgttatacatggaaatacaaaaaaagtttcaaagtcaaatattgataagatacagaaaattttggaagaacatcagtatattccaagtatgagtgcattgatgctggcgcagaatcgttccagactgataggtgttttgattggcggggtagatggaaaaagaagaagtattgaaggtgacccatttaccagcattatgttaagcgcacttgaattagagatttacagaaaaaattattatatgctgtttcacatgtcgagtacatcggaagaaagctggaagttggcagcgacgtggaaagtagagggtttgattacacttgggcttacagcagaacagaatattgaacttcaaaagaggtgtcagattccattggtcagtattgacaattattatgagggaagagaacgggcagaaaatatagggcttcaggattttgaaggaggttttaagatgggaaattatctgatagaaaatggaatgaaaaagattcttttcctgtcagataatgatattggcgtagaccatgagcgttggctcggacttcaaagagcagcaaaagaaaatggttcagttttggcgaaacattggattatgccgataaagcaggaatttcagatgcagtggttaaaagaccagttggaagaaatttgtaaatgggatgcattattttttgcttcagatcgttatgcacaggaaggaattcttgtgttacaggatatggggattcgtgtgccggaggatatttcggttgttggatttgatgacagtccttatgcaaagatgtgcagaccacagcttacaacagtgcgtcaggatgtcatgaaaaaaggaaagatggttgtaaagaaactaatgagtctgataaaagaagaaccatttgatggagaagaacggcttccggttgaactggtggttcgtgattctgtacagaatagagaataagatttaggtgaaatggacgttttgcgaaaaacctattgtgatagaaaacacagtttgctataattggtaatagtaaataaggttttacgcaaaacgtttttgcgtaaatgaaagcagataattattgctttgaatctatatatcagatttatatagcaaagtgagaaaacgtgtctgatttatcagaacgattagaaaatggatgaggtgaagattatggaaaaaaaatggtggaaagaaagcgttgtttatcagatttatccaagaagttttaaagacagcaatggagacggaattggagatatcaatggaattacagaaaaattagattatttaaaagaattaggaattgatgtaatctggctttctcctgtttatcagtctccgaatgatgataatggatatgatatcagtgattatcaggcaattatggaagagtttggaacaatggaagatttcgaccgtatgttggcagaagctcataagagaggaatccgaattgtcatggacttggttgtcaatcatacatcggatgagcatgcatggtttgtagaaagtaaaaaatcaagagaaaatccatatcgtgactattacatctggagagaagggaaagacggaaaagaaccaaataactggggttctgtatttaacggttctgcctgggtttatgatgaaacaacggatatgtattatctgcatctgttttctaaaaaacagccggatttaaactgggataatccaaaagtccgtgaagaagtcttttctatgatgaactggtggtgtgaaaagggaatcgatggtttccgtatggatgttatcagtatgatatcaaaagtagaagggctcccggatggaaaagtgcagggaggtctctatggagatgcttctccttatgtacaaaatggtcctcacgtacatgaatatctgcaggaaatgaataaagaagtactttctaagtatgacctgctcacagtaggagagtgtgcgggtgttacaattgaagaagcgaaaaaatatgcttccaataaaggaacagaacttggaatggtattccagtttgaacatatggatttagatcagggcgaattttcaaaatggagcgataagaaggtcaagctgaccgctttaaaagaaaatttgacaaaatggcagaacgaattagaaggaaaagcatggaacagtttattctggtgcaatcatgatcagccaagagttgtctccagatttggaaatgacagtaaagaatatagagaagtttcagcaaaaatgctggcaacctgtctccatctgatgcagggaacgccttatgtatatcagggtgaagaacttggtatgacaaatgttccatttgcgtctgttgatgaatttaaagatattgaaagtatcaatgcttatcatgaatacgttgagagtggattgattagtaaagaagatatgatgcgttacctttgctataagagcagagataatgcgagaactccgatgcagtggaatgctcagaaaaatgcaggatttacaacaggaacaccatggattaaggtgaatccaaattatgtggagattaatgcggaagaagaagtaaaacgggcagattctgtcttctcttattataagaaattgatcgcattaagacatcaggaagaagtaattgtgtatggtcattatgaactgctccttccggaaagcgaagaattgtatgtttatacaagagaattaaatgaagaaaaacttctggttatctgtaactttacagataaagaggtttcttatgcggttccggatgaatttgttggaaaagaaatcctaatcagcaattatgaagaacaggaaatcaaacaagaactgagtctgaaaccttatgaagcaattgtagttagaagatagcattttgtttgtataaagcaggtgaaataagacgcacagatagtggaaggtactgtctgtgcgtcttacatttactgctgttttaatagtagtaaatgcttggaaattcatagaatctaggatagtagaaaaaaattgaaaaaaagtgaaaaaagctgttgacaaatgatgaataatgatgatattatataacacgaattgttgattcgttgttaaaatagttttaaaaagtttaaaaaaataaaaataaaaaaactattgacaagctgataaagatatggtattctattaaagctgtcgcagaaaacgacaacaaatcaaaaattaaaaactttgaaaaaagttgaaaaagttcttgacaaacaaaaacagctttgatataatataaaagctgtcgctgataagaaagaacgacaggaaccttgataactgaacagtgaaacacatgaaaacgaaaattcttttacattcatttattttaaaaagaacggttcaatgaaccaaaacagtaaaagggatagatagccaagtagttatcttgaacttggacaaacactatatcagagagtttgatcctggctcaggatgaacgctggcggcgtgcttaacacatgcaagtcgagcgaagcgcttacgacagaaccttcgggggaagatgtaagggactgagcggcggacgggtgagtaacgcgtgggtaacctgcctcatacagggggataacagttggaaacggctgctaataccgcataagcgcacagtatcgcatggtacagtgtgaaaaactccggtagtatgagatggacccgcgtctgattagctagttggaggggtaacggcccaccaaggcgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagagcaagtctgatgtgaaaggctggggcttaaccccaggactgcattggaaactgtttttcttgagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgttggggagcaaagctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcgatctgaccggttcgtaatggaacctttccttcgggacagagaagacaggtggtgcatggttgtcgtcagctcgtgtcgtgagatgttgggttaagtcccgcaacgagcgcaacccctattgtcagtagccagcaggtagagctgggcactctgatgagactgccagggataacctggaggaaggcggggacgacgtcaaatcatcatgccccttatgatttgggctacacacgtgctacaatggcgtaaacaaagggaagcgagcccgcgagggggagcaaatcccaaaaataacgtcccagttcggactgcagtctgcaactcgactgcacgaagctggaatcgctagtaatcgcgaatcagaatgtcgcggtgaatacgttcccgggtcttgtacacaccgcccgtcacaccatgggagtcagtaacgcccgaagtcagtgacccaaccttagggagggagctgccgaaggcgggattgataactggggtgaagtcgtaacaaggtagccgtatcggaaggtgcggctggatcacctcctttctaaggaagaagaagtagtcgtaagtgtttcactgttgagttatcaataaaaaacagataacaacatatttccggtggcgatgcgcttaggggagacacccgttcccatcccgaacacgatggttaagacttaagcggccgatgatactatgctggagacggcatgggaaagcaggtggctgccggattacaaaagagggcttatagctcagctggttagagcgcacgcctgataagcgtgaggtcggtggttcgagtccacttaagcccactgggtgatacccagaggaaaaaagtaaatatggggatatagctcagttgggagagcacctgccttgcaagcagggggtcgagagttcgaatctctttatctccactcggtaagaaaacgaaagttttactaccgtagtcgtaccttgaaaactgcatatacgaaacatctaaaatacgtaaaacgtaagatagagacgaaacgaggcgctgtagaaatacagcgatgaaatagaaacaaaccaagcaacaccagccgtcagatgttaacgctataagatctgaatggccaagcaaaaaagagcgcagggtggatgccttggcactaagagccgatgaaagacgtgataagctgcgaaaagcttcggggaggagcaaatatccaatgagccggagatgtctgaatggggaaacccacatgagaagacctcatgtatccatacgccaatccataacgtatggaggggaaccgggggaactgaaacatctaagtaccccgaggagaagaaagaaaactcgatttcctaagtagcggcgagcgaacgggaaagagcccaaaccagtgtgcgtgcatgctggggttcggactgtataattgattccttgattctaccagaatggttttgggaaagccagccagagagggtgaaagccccgtatgggaaaggaaagaggacaagacaggatccagagtaccacgagacacgagaaaccttgtgggaaggagcggggaccaccccgtaaggctaaatactccttagtgaccgatagagcatagtactgtgaaggaaaggtgaaaaggaccccgggaggggagtgaaagagaacctgaaaccctgtgtttacaagctgtggaaccgctttatatgcggaaccgcgtactttttgtagaacggtccggcgagttgtgcatgctggcaaggttaagcgctaaaggcgtggagccgtagggaaaccaagtctgaatagggccagagtcagtatgtgcagacccgaaaccgggtgatctatccatgtccaggttgaagctgccgtaagaggcagtggaggaccgaacccacatccgttgaaaagggtggggatgaggtgtggataggggagaaattccaatcgaacccggagatagctggttctcctcgaaatagctttagggctagcctcgatagagatacatggaggtagagcactgaatttcctagggggcgtcaaagcctaccgaagaatatcaaactccgaatgccatggaattgattatcgggagtcagactatacgagataagttggatagtcaaaagggaaagagcccagacctccagctaaggtcccaaagtacgtgttaagtggaaaaggatgtgggatttcgaagacaaccaggatgttggctcagaagcagccatacattcaaagagtgcgtaatagctcactggtcgagaggtcctgcgccgaaaatgtccggggctaaaacacgacaccgaagctgaggaatgtatttgatacattggtagaggagcattgaatacgggaagaagcagtaccgaaaggagctgtggactgtattgaagagagaatgccggaatgagtagcgagaataaggtgagaatccttatggccgaatatctaaggtttccagggtaaagctgatctgccctgggtaagtcgggacctaaggcgaggtcgaaagacgtagccgatggacaacaggttgagattcctgtactgcgttagaacagaactgtggggacacgtgtggaaagcacaacccgggaatggaatcccggggcaagcgaaggaggagtcacataggaaaaaccgtgtgacaatccaaaggcgtgatgcggaccgaactagagtagggaagtgtgtgagccatgcgtcaagaaaagccgctattgtttgtaacgtacccgtaccgtaaaccgacacaggtggatgaggagagaatcctaaggccgacggaagaagcattgccaaggaactcggcaaaatgaccccgtaacttcgggagaaggggtgcccgtgtaaaagcgggccgcagagaataggctcaagcaactgtttagcaaaaacacaggtctatgcgaaaccgaaaggtgaggtatatgggctgacgcctgcccggtgctggaaggttaagaggagatgtcaggaaacgaagcattgaatttaagccccagtaaacggcggccgtaactataacggtcctaaggtagcgaaattccttgtcgggtaagttccgacccgcacgaaaggcgtaatgatttgagcgctgtctcggcaatgcatccggtgaaattgaagtaccagtgaagatgctggttacctgcgccaggacggaaagaccccatggagctttactccagtttggtactgggattcggtattgcatgtacaggataggtgggagactgagaggtagtgacgccagttgctacggagtcgatgttgggataccacccttgcagtattgggtttctaaccagccgccgtgacccggcggtgggacaatgccaggcggggagtttgactggggcggtcgcctccgaaagggtatcggaggcgcccaaaggttccctcagaatggacggaaaccattcgaagagtgcaaaggcagaagggagcttgactgcgacaccgacgggtggagcaggtacgaaagtagggcttagtgatccggtggtattaagtgggaatgccatcgctcaacggataaaagctaccctggggataacaggcttatcactcccaagagttcacatcgacggagtggtttggcacctcgatgtcggctcatcgcatcctggggctgtagtaggtcccaagggttgggctgttcgcccattaaagcggtacgcgagctgggttcagaacgtcgtgagacagttcggtccctatccggcgtgggcgtaggatatttgagaggagctgtccttagtacgagaggaccgggatggacaggccgctggtgtatctgttgtagtgccaactgcatggcagagtagccaagcctggaagggataaacgctgaaggcatctaagcgtgaagcccccctcaagatgagatatcccattcgtgagaagtaagaccccttgaagacgacgaggtagatagggcagaggtggaagtgcagcaatgtatggagctgactgctactaatcggtcgagggcttgaccagaaactgagaaatcagtggagcggcaagtgtctgcatggtttcggttttgtatatgtagttttgaaggtacgatgaatgaatattcctccttagctcagtcggtagagcatgcggctgttaaccgcagtgtcgttggttcgagtccaacagggggagcttgttttaaataacataaatatccatggctccatggtcaagcggttaagacaccgccctttcacggcggtaacaggggttcaaatccccttggagtcactcaacagaatatgttgacaaactagtctataatatgttagactaaaaacgtgccgatgtggctcaattggcagagcagctgatttgtaatcagcaggttatcggttcgagtccgatcatcggcttcatggacctttagctcagttggttagagcaaccggctcataaccggtcggtcctgggttcgagtccccgaaggtccatcgctaaaggttaaatgaaataataaaatagaataaggcccagtggctcagttggttagagcgccgccctgtcacggcggaggtcgagagttcgagtctcttctgggtcgtttcgagtaaatcactcgatatgccgcagtggcggaactggcagacgcccgggacttaaaatcccgtgggtagtgatacccgtaccggttcgattccggtctgcggcattaattttttgcttcaaattcagtaaggatttggagcattttttcattttgtaccaaatttgtaccttgttctaagaatacacatcattctaatatctctcaatctttgagtggaaaaatcccaattatttttaaatttcatacaaaaaggcttcaaaaactgtaatcctttgttataatatttttaaagaattaaaatagagaaaggaagcgaaaaaagatgaagatttgtccaaaatgtggaaagcggtatgaagaaaaccaaaatttctgcaaaacttgtggaatgcgtctggtagaagaaaatcagcgcccatcaggaaatccgccagtaaaaaagaaaagtcatatcggtttatacataatgattgtaatctttgcaatctgtataggtgcaggtgcttttgcagtggttaaaatttctgataataaaaaacaggaagaagcagagcagagtcaggtcagtaagaatgataaaagcacagacaaagccgatagtaaagatgtggaagagaaagattccagagaaacaaaaaaagatgcagaagaagatgtagagccggttgaaggaactatgaccgcagaagaaaaggcaaaagcagaagaaaagaaacaaaaagaagaagaaaagaaaaaagaagaggaagaacagaaagaattattaaagaaatacgaggaacaggaagcacaggaggcagaagcagcgaagaaagcagaagaagaaaagaaatcccaggaagccgcttcaaacagtcagagtgcttcaacaagttcatcaagttcaaccggcagtagtaccgacaacagtctttatgcaagctggagtgaaaaattagtgggagcagaacaaagtgatacagccattttaaatgaagtaggtgcttcggatgactttaatacaaagatggcaaaacaggaagcacgttatcagttatgggatgggctattaaatcagatgtggcaggatttaaaggcatccttaccggaggatcagatgtcacagcttacaagtgcgcaggtggattggattcatcaaaaagaagcaatgatatcacaatactgggaatctcagaatgtggatcattctggatttaatgaagcaccagcggcagatacaaccaaacaaagagtgtattatctgttggattattgtccaagaagtaattaaccgaatcaagtagtgaagcagatttagaatatcaatatctgcttcactccaacgtaattacagttctaatgatgttagaatcaaagagggaggtttggatatatgttttgtaaatattgtggtagggaaattaaggagggcgaaatctgtacctgtagacagcagagttctaaaactccatatccaaagccggatattcgtccagtcatgcctgaacaggaaaatacgcagagacaaggaataaatcagaatcagggaaattctcaaaatcagggaacgactcagaatcgcagacagcagactcagtttgagagaaaaccggtaaatagaacaccagtaaataaaacatcaactgcaccacaaaatcagagaaccggaaaaaaagatgggaaaggattggcagttgcgtctttcctgcttagttttttgcttttagtcagctttgttttattaagagttgtattgcaagatttcatgcaggaaagtactatgttggagagtatttatccgtatttaatttatgttgtgccgtttttacttggtctgggagcatttttatgtgcaattttttctcttcaggatgcaagagtgcgtacgctttcgatttccggaattttaatcagtgcgatttttgttgcaggaatttttgtttctaaggtactgtttccttatgaagcagacagctatgtggcttcatcggatagaagtgatgaagaggacgaagaagaagtcggtaaagataattctaaggatacagaagatgcatcgaaagaggaagaaactgcagagtcggattcttctatttcccagattaagagtgattatcaaaaaggaacacttgattatgcaggcgtaaaaaatgcgttagtaaaacttgatacagataaattggaatcaaaagaagcagaagaagttttagcacttcaggagcagacggaaaaagatttagaggacagtcttgaaaaatccgcaaaaagttccgattatgaaagtattttaaagaaactttcaaaacaaaaagaagagttaaaagacgaggatgagcttatcacaaaactgagtgaaaagtatgaaccagaatatattttgtatttagatacagagagcaagaatctgctggcacagggcaaaaaggacgacgcattaaaattattaaaaaatggaaaaacattggtggaagataccgatgcggtggataatttaattgcggaagcagaagagggagtaaccggaggagattatattttaccggaaagtaacagcagatatcttacagatgcagatgtcagcggattaacgcttcagcagttaaattatgcgaaaaatgaaatctatgcaagacatggaagaaaatttgattctaaggaactccagaattattttggaagcaaatcatggtataacggaacggtcaatgcggctgattttaaggaaacagtgtttaatgaatatgaaaagaaaaatgcagaatttttaagacagaaggaatttgcaatgcatgatggaggatatcagttagaccagtaagaaagagtgaggagaagaaagatgaagtgcattaattgtggatgtgaattgccagagggagcaagattttgcggtaattgtggagcaccacagccggagcatcaacaggaagaacagcagtcaggacaacaggtgcaacaaagattttgtcctcattgtggaggagcgaatgatgccgatgctgtattctgcagtatctgtggaaaggatatgaatggggacggacaaccggtggttgaagaaaccatgtcaaagaaagttctgaaaaagttaattgtgggagcagtaggtgttgttgcggcagttgttgttatcggcggagttgtaaaaatcgttggaggactgggaggcagtaaatccgattcttacatcacttatgtaaaagatggttatattaatcagtccgatattgaacattataagaaaaaaccagtagagtatcagggaagatacggaagcacaagtgatgatggagagaattattctgccggtgtgagttactccaaagatggaaaatacatctgttatcctacagatgtaaattatggcgatgatggtatagaatttcgtttaaatatgcagaaagtaggaaagacagaagagccggttaagattgacagttcggttacaagttatacaattttggacaataataaaattttgtataagaaagccggaaatgatacgctttatattaatgataagaagggaaataaagaaaaaattgcttctgatgtcaactatttttatttagacagtgaccagaaaaatattgtgtggagcgaatcaaacggagatggcacgattaacgtctgccagcaggatgttgcgcttaaaaaagagaaaaaaacgttggcaaaagacgtggattctttctatgcaagcagtgatttaaaatatgttgtagtccaggaacaagatactctttatatggtggaaaattttggagaaaagcaaaaaattgcttcgggtgtagaagatgtttcttacgatggtttagataatggaggaatctattacacaaaaagttcagaggaaacattaagtgcagaagatgtggttgaagatgactgtgcagacagtgatgcaacgattgaagagccggatagagaagattataaagttgaaaaaatcgagaaaaatgactggaccggaaaatacgaaaaagtagagtctgtagatgaagatgcttatgatgcggcttatgaaaaatattatgacaaagaaaatcgagatgaaattcgtgacgcattagaggattatgaaatttctacaccagtggaaaaattgtattatgtaaaagatggaaaagaaacacaggtagatgctacagttgcacagatgtattattatactggagactggaagggtattgtgtatagccgttataatatggatgatgttccgaagttaaaaatttctgagattgacagtgccagcagtattgagtctgattattatcagatgctttcagaatccgcacagacttgtgtgtatacagagaaagacaaaaccgttgtattggatgaaaatcttgcgactgtatggggcgtagatgcagattctaaaaccggatatggagtaaaaatgcaagattccggttcagaagatgaagacgcaacctataacttatattcattctctgtagataataattcagatggaaaatgtaaactgatttccgaagatgtggcatattatcaggaattaataaaagatggagatgtgtactatctgaaagatacagacagtgacggaaatggtgatttatattgtaacgacaaaaatattgattctgatgtaaaatccggaacgctttatacagtgccagattccgataatgtgctttatgcagttgattacaacagttcaaataatagtgcaactttaaaaatgtatgatggaaagaaagacaagattattgcagatgatgtctattcttatcttccaattgatgaaaaacatattgcacttttgattgattatagtatgaagtcttatcgtggtgacttacaatattatcttggaaaagaagaacttaagagcattgatgaggatgtcagctttatttttggcggaaaagagatttattaaaaaaatttattagaataaaatttacgagagagtttagaaatcagggagtttaatttgtgaaacggatgtataaaatcatactgggatgcctttcaattgtcttgattttactaattgttgttgcgctttttcaattaaatcaggtaaataaaacaagacaacaggttactgcggtaagaaaagaaatcagggcaattaagaaagacatagaaaaacaggaaaaagagcagaagaaggcagaaattctgcaaaaagaaacaaaagatgcagagcagaaagaagaagcggataccgatacaaaagcggaagaatcagaagagcctgcagaatctgtagaaacgcaggaagaagcgcagaaagaagcaaaagaaccggaagctggggaagagcagaagaatcaggaaacggatgccaattcacaggtgccagagaccggtaatggaaagaaaatcgcaattgatccaggacatcagggttacaatgtagatatgagtgcacaagagccaatgggtccaggttcaagcgaaatgaaagcaaaggcaacgacaggaacacagggaagttttaccggtgttcccgagtatgagctgaatttaaacatttcaaaacagcttcgtgaagaacttaaaaaccgtgggtatgaagtgatgctgacaagagaggacaatgatactgcaatcagtaataaggaacgtgcagaacttgcaacacagtatggagcagatatttatgtgagaatccatgcaaatggaagtgatgacagcagtgtcaatggggcatttacgatgattccgtctgcacagaatccttatgtcggagcactgcatgataagagctatgcacttggagaagcggtcattaatgcctattgtgaatcttgtaaaattaaaaacagcggagtacagatttttgacaatatgacaggaattaactggagtactgtgccggttattattctggaaatgggatttatgtcaaatgaaagtgatgatacaaatatggaaaatccggatttccagaaattaatggtacagggcattgcaaacggtattgatgcttattttgcagcaggaaattgagaaagagaaatacaataaggaacaaataaaaaatggaaaaaaagaaaaagacaaaggtaattgcaggaatcgttgttttagcggttttgattttagcggttctttgtgtgaacgtatatctgaaagaaaaacagaatactcagaatacaaaatatacagaagcacaggaagaaaagaaacaattagaagaaaagcagaaagcactgaaagaaaagcaggcagaagcagaaaatgccgaaaatacaacgcaggagcaacaggattcagatgaagccggagagcctgtagatgaaacagaagaagatgcggattctgaggaaagtcttacagaagaacagcttgcagaagaagatgctcctgatttggaagcaattcgtgcgtcagtggaagaaaaactgcaaggtacagatgaatttggagaggcatggcagatttatgtgtatcgtttgaaagatggcgcaagagcatctcttggtcagggaagattgacagcggcaagtttaatcaaactttatattatgggcgcagtttattcttcttatgataatatcgctgctgcaaatggacaggagcaggtagataagctgttaaatgcgatgattacagtcagtgataatgattctgcaaatacactggttggaatgttgggaaatggtgataatgcagcaggtcaggaagcagtcaatacttattgtaaaaataatggttacaccgatacttccatgggaagaatgttgcttgaaaaagcttctgcgaacgaaaattatacgtccgcaagagattgtagtgtgtttttgaaaaatatttatgaaaataaattagaacattctgaggatatgttgaatttattaaaacagcagacccgaacagaaaaaataccaaaaggtattccatctggagtagaaacggcgaataaaaccggagaattagaccatgtagaaaatgatgcagcgattgtatttgatggagaaaatccatacattatctgtgtgatggcagataatttaagtgatacgacggaagcgagacagcgaattgttgacatttcttcggttgtttatgagaatatttcaaaataaaaagagcagacaaaaaggatatcgaagtcaataagttttggctaagatatccttttttgctggtttgttttgaacaagaaattatttttggcagattattttctgtaaattattttctgcggaagcggttcaggcaggcataaatttcctgttttcgtggcatggcaagtccgcaggaaagataagaggtactgttgatgccggagaagccttttgtttcgagaatagaaatcaattttttagcaacttcatccaaagtaagctgattgtcaatcaaagattcacaggcaaaacggagcatagatgcaagcgctgatgtctgttcaaaatctgcaagctgttccacatatcgtaaatcaacggtttcttttccaatcgaaaaggtatatcggtcgtgtgtttttacttttaaacctctatctgcatgagaagcatgaggatttcttgaagtttttgtttgaaaatccggtgtgctcatgattcggtaactgtcaggctgatgaaattctgtggcagaagttttcggaagcggattttctttgcacagtacttttgtagaagtcgtaatatcgattgccttatagcagtccatttgaataatagtgtctgcgatatgaaagaaagcaccactgcttccggctacaagaatggtggaaattcccgctttttcatataaatctctggcacgttctaagaaaggagtaattggctctttacttcgaccgatgactttttgcataaaagagtcacgaaccatgaaattagttgcagaagtgtcctcatcaataaagaaaagagaacttccggcctccatgctctctacaatagcagccgcctgagaagtactaccactggcgtcacaggtagaaaaacaatgagtatcttttttatttggtaaatcgttaataaaaagggaaatatccacatcttttatgaaacgtccatcttcagccctaagttttacgccactgtcatcggagattacatattctcgaccatcgcctgcgatatgattatagactccgctttctaaggcatttaataaagtggattttccgtggtagcctccgccgacaattaaagtaattccttctttgatgccgagtcctcgaatcgttcctttgtgtggaagcgtaagttcaatggcaagagaatccggagcaaaaaacggaatactttcttttaaaggtttatcggaaacaccactttgtcttggaagaatagaagcatcggcgacaaaggcagtaagatgaaggcgtttcagttctttacgtagaaaatactggtcctcagcgagaaaataaacctgttctaccactttagtgttctgattgcggtagaaaaatgctttttctacacagactggaagaaaatcaaaaaagattttttctaattctatagaattgatacgtctgccgtttgcgggaaatccaacaaagaaacgtgcaatgatagaattttttgtgatttggcaggcacttcgctctaaaatctcctgaccgcagtgtgtgacagaaatcagaccgctttttccagaaccttttgcacggaaactatagcggtttacctgctgttcaaactggcgggtcagatagtcctgcagtgcaatgcgggtgtaggatttttgatagtaatcagcagggaatccggcagtttttagcggaatctcaacgctgatactggatggagaggcaaatgggtctccctgaacatggtcaatgtataaaagatagtttggaaattgataagtgccacgtaattctttataggcaggatagcctttttgatgaattgcgtggagtttggtctgtaagtcatttgaagtttttggcatagtaaaaaacccctttcaaaattataaaaatctaggattactatagcgaaaatacagagaaatcgcaagtttcgcaaaaaataaaaaaatttcaaaaaaagggttgactttttggaatatgtacattataataggttttgttgttgaggcaatacaaaataaataagaaatatgtgcgtttagctcagctggatagagcgtttggctacggaccaaaaggtcgggggttcgaatcctctaacgcacgctagtaaaaaagtagacagggtataaaaaccctgtctatttttttactagcgtgcgttagaggattcgaacgggttcgttctccgctccgctccggtcgttgctaagcgcatgccacaggcatgcagcaacctctaacgcacgaaagcaaaggggaacgttatctctgatttgtttttgcttagatttgagtggactcgaacgggttcgttctccgctccgcttcggtcgttgctaagcgcatgccacaggcatgtagcaacctctaacgcacgaaagcaaaggagaagagtgtacaaaaaaacggtctacttttttacacttgcagaacatgtaatctgttgatataatacaagttaattgtttaaagtggtaaaatcaaggagaaaagaaaaatggaaaataaaaagttgtttgattataatatttttttgattggatttatgggatgtggaaagtctacgatagcgggatatttgcatgatacattttccatggatgtggttgagatggatgatattattgcacaacaagagggcatgagtatttcagatatctttgaaactcatggagagcagtatttccgtgatttggagacaaatcttttagttgaaatgcagaataagtctaatgtagtgatttcgtgtggcggtggtacttcaatgcgtgaaaataatgtgcttgagatgaagaagaatggacgtgtcgtgcttcttactgcacaaccggaaactgttttgcagagagtaaaagacaatcatgaccggccattgcttgaaaataataaaaatgtatcatttattgcagacttgatggcgaaacgaagtgagaagtatgaggcagcagcagatatcattatacagacagatggaaaaaatgagcaggaaatctgtgaggaaatgattcagagacttcgtgtgatggatgaaagtagatagaaagcaggtggctgtagttacaagcagccaccttatattttacaggcttttatgaaggatatccaatacttgtttaagctcatttactggaatttgtcctggggcagaagcttttgtggcagctccaaatgtgagggcagagccaaaggcttcaccggcaagacggctgatgacacctgttccagccattgacatggtaataatcggacggtcggcgtaagactcagtcatttcaagagttgcatcaaggagcataagcacatcacgtctgcaggttggcatgactgcaatttttggaatatccgcatcaagttcctgcattttacaaagacggcggattaattcttctttttcaggagttttatcaaaatcgtgattggaagaaactacttttacattaaaatcgtgagcttttgagatgatgttcgtcacaatttcgtctcctgtaaaagcttctacgtcaatcaaatcaacaaagccgcttttggcaactgcgagattaaggttttgataagcttcatttgagatggctttttctcccccttcttttgccgtgcggaaggtaaaaagaattggtgtgtcttttaagacagtgtttaattcttttgcggtttcgagtactttatcggtatcaaaaacatcttcgtaccagtctgcacgccattctacaacgtcaatcggaaattcggcaaaagaacctgcttccgtgagaatttcttctttggtttgtccaacaatcgggacacagattttcggtcgtccctctccgataataacatttcttacttgaactgttttcatagctaaaatcctttcctatattcaatcagcattgattctacggttcagagttcaaatgcagcagaaccttgaaacattttctggattgtgaaaaatttttctataagttagcataattagttagagcaggtttgtcaattataaaaaagattctcgcagagcgtttttaattttatacgatgagttttttatgaatgcagataagcattcccccgcttcaagtgcgcagagcactaagcggcgggtgagggggatgcttctgtcagtggaagttgaaagctcccactgacagatcgcaaagcgactgcgttcatgagcaagtagcgaagcggattgcgaatgtccgctttacataagaaaagaaaaagtccggatggaatttaattccgtccggattttttgactaaatgaaacaaactttgtggaatcccgaatccaaagatgattccaagtacaattgcacctgcaacttcaaaggtttcaattcctttggaagaagaaaatgcccggtcattggtaaatagatagtaggcagtgtaaaagattccagctccaggcacaagaggaaagataccggttaaaagatagacggtaacaggagtggagcggatgactgcaaagattcgtgccaaaatcgtaaggcagaaagttgcaatcagggatgggacaactacgcccatgccaagctggactaaaatgtagtagagaatccatccaaatgcgccgctaaaaccgcagtaaagcagttctttttttggtgcggaaaaaaggactgcaaaggaaaatgtagcaaagcctgctacaataaattgaatgataaattctataatagattctataatagattccatagcttagagtcctccgaaataattcataatgacgaatggcagacaggcgccgactgcaatacagatagcggtaattaaggcgtcaagcagatgaattgtacccgaaagataatctgcattataaatgtcacggattgcagtggtaaatgcaattccagggacaagaggcataattgctccgatgatgattttatcctgtaatagattcagattggtcagcatacagagcattgcgagtaaagtgacaaacaggcttgcaaaaatgtttgtgataatctttgaaaatttatattttttcagtgcaaataaaaggagctgttctaaaataccgatgccaaatgtaaaaagagaatcaagggcacttcctccaaataagtaacagaatccggcacttccgagtccgcagaaaaagaccagaagggaattaggataattgggaaggttctgacagcgttccagttcctcccaggaatcaatcaaagaaatcttatgttcgcagatatctctggcaagttgatttaaagcagagatttttccaagatttaccgaaccaagcggaacatggcgcacaatactgcaggcatcttcctgattttcattggcacttgcaaagattccgttggaaatgacgtagacgtcaaattcttttacttcataagattttaaaatgtggacaacagtatcttccacacgataaatttctgccccatttctaagcatactgtcaccgatttcaacagccagggtcagtatttcgtttgtataaaccataataaacctcgttatttcttgaaattattatttaagagaattatatcacatcattttattttgatggaataaaatgagacttgtgatataataaagaatcataggttgtatgttaagaaaaacaaaacctgtcttgaaattataacaaaagatattttataataaagcgaattatctacaagaacaaagaaggagaatgaaaaggaaaatgcttaagggaaagacggttttattaggtgtaacaggcagtatcgccgcatataagattgcatatctggcaagtgctttaaagaaactgcacgcagatgttcatgtattaatgacgaaaaatgctacgaattttatcaatccgattacatttgaaagtctgaccggaaataagtgtctggtagatacctttgaccggaatttccagtttcaggtagagcatgtttcgattgcaaaaaaagcagatgtggttatgattgcaccggcaagtgccaatgtgattggcaagctggcacacggaattgcggatgatatgctgactactacagttatggcatgtaaatgcaagaaaatcatttcaccggcgatgaacgtcaatatgtttgaaaatccgattgtgcaggataatcttaagattttagagcactatggatacgaagtgattcagccggcatcgggatatcttgcctgtggagatacagggacaggaaaaatgccggaaccacagactttgcttgcttatatagaaaaagaaattgcctgcgaaaaagatttaaaaggaaagaaaattttggtgacagcaggtccgacacaggaggcgattgaccctgtaagatatattaccaatcattcatctggaaagatggggtattcggttgcaaaagcagcaatgcttcgtggtgcagatgttacactggtgagtggacgtactgcaattgagccaccgatgtttgtaaaagttgtaccgattgtgactgcaaaagagatgtttgacgcagtgacttcggtgagcgatgaacaggatattattattaaggcagcagcggttgcagattaccgtccggctgttgtaagttctgaaaaagtaaagaagaaagatggagaaatgtcgattgcgttggaacgcacggatgacattttaaaatatctgggagaacataaaaaagaaaatcagtttttatgtggattttcaatggaaacccagaacatggtgagtaattccagagccaaacttgagaaaaagaacctggatatgattgcagccaataatgtaaaagaaaagggtgcaggatttcagggggataccaatgtattgactctgattacacaggaggaggaaacgtcacttccgcttatgagcaaggaggatgcagccaatcagctcctggataaaattcttatgctgacttctaatcaaaattaattctaaataaaagaaaaaggttaaaagattaaaaattaaaaaaaagaggtcagagtaaccacaacaccgtattgtatccgcaaaaggcggaacgagaacaaggaggaaaaatgaaaacaaaaaaatttaccacaacacaacttgccattctgggtctgatgacagctatcttattgattatggcatacacgccgcttggatatttgaacattggaccacttgcgatttcattcaatgtgattccggttgctatctgtgcaattgtgttaggaccgatgggtggagcaattgcaggagctatctttggactgactagctttgggcagtgccttggaattggcggagtcagtgcaatgggagcaatgctgcttagtattaatccatttctggcattcattcagagatttattccacgtcttttcgatggaatctgtctgggatatatttacaaagcgatgagaaagagaacaaatgcttatgtttcctgtgcagtaaccggattcttttctgcatttttaaacactttattctttatgactcttttagtagggctgtttggaaataccgagtatgtaaaaggcttgatgggtggaagaaacatcattatcggatgctgtatgatggttggagtcaatgcagtttgtgaaatgctttcttcaacattgattactggtgcggtaggagcagcactttcaaaagcacgtctgcttccggtagaacaaaaagggaaacgtaagtagattatagaatcataggagaaaaaagatgattttagcaattgatattggaaacacaaatattgtagtaggctgtattgatgagaatgagatttattttacagagcgtctttctacggtaagaacaaagacggaactggagtatgcagttgatttaaaaacaattctggatatctatcacattaagaaaacagagattgaaggctgtattatctcttctgttgtgccacagattacaaatattgcaaaacttgcagttgaaaaaatcttaaaaaagaaagttatggtgctcggacctgggattaagaccggtttaaatattctgatggataatcctggacagcttggagctgatttggtagctgatgcagtagcagcaagtaataattatccggcaccgttgattgtaattgatatgggaacagcgacaaccgtatctgtattaaatgacaagaaacagtacatcggaggaatgattcttccaggagtcggtttgtctttggatgccctgacctcaagagcttctcagcttggcggaattgggattgaagctccgaaacatctgattggaaaaaatacaaccgaatgtatgaaaagtggtatcatttacagcagtgcagcatccttagatggaattgtagaacggattgaagaagaacttggaacagaagcgaccgtggttgcaacaggcggacttgcgaaaaagattattccttattgtaagaaaaagattacccttgatgaagaactgttattaaaaggactgctgattatttacgagaaaaataataaataaaaaaagaaaagtacagaacaaacattcgatttgctctgtactttttttatttggaatgataaactaaaaaaagaaaacactattaacgaaagcagtttttatgaggaaaaatatatggatcattttgaattagtatcagagtacaaaccaaccggtgaccagccgcaggctatcaaggagctggtagcaggatttaaagaggggaatcagtgtgagactcttcttggtgtaactggttcgggtaagacatttacgatggcaaatgtcattgcgcagttaaataagccaactttgattattgcacataacaaaacgcttgctgcacagctttatggggagtttaaggagttttttccgaataatgcagtggaatattttgtctcctattatgattattatcaaccggaagcttatgtgccgtcttctgacacttatattgcaaaggattcggcaatcaatgatgagattgataaactgcgtctttcagccacttcttctttgagtgaaagaaaagacgtcattattgtttcgagtgtttcctgtatttatggaatcggaagtccaaaggattatcagaatatgattatttctctgcgtccgggaatggaaaaagaccgggatgaggttgctcgggaattgattgatattcagtatgatcgcaatgacatggattttcacaggggaacatttcgggtgcggggagatgtgttggaaattttccctgcggattatacggatacagcggtaagagtagaattttttggagatgagattgaccgtattacagaaattaatgtactgaccggagaaataaaatgccagttaaatcatatcgcaattttcccggcttcgcattatgtcgttccgatggagcagataaaaaaggcagccattcatatagaagaagaattagaagaacgggtgacatattttaaaagtgaggacaaattattagaggcgcagagaatttcagagcgtacaaattttgatatggaaatgttgaaagaaaccggtttttgttcgggaattgaaaattattccagacatttatccggcttagagccgggacaagcaccgtatacgctcatggattactttggagatgactatttaattatcgtagatgagtctcataaaacggttccacagattcggggaatgtatgccggagaccgttccagaaagacaacactggtggattatggatttcgtctgccatcggcactggataatcgtccgcttaattttgaagaatttgaaagtaaaattgaccagattttatttgtatctgctacaccgggggagtacgaggaacaacatgaactcttaagggcagaacagataatacgtccgacaggacttttagatccgatggtggaagtacgtccggtagagggacagattgatgatttggtttctgaagtgaataaagaagtcgagaaaggaaataagatactgattaccacactgacgaaacgtatggctgaggaattgacggattatatgaaagatttgggaatccgtgtgaaatacttacattctgatattgatacgttagagcggacacagattatccgtgatatgcgtttaaatgtatttgatgttttggttggaatcaaccttttaagagagggactggatattccggaaattacattagttgcaattctggatgcagacaaagagggattcctgcgttccgagacctcactgattcagacaattggtcgtgcggcaagaaatgtagagggacatgtcattatgtatgcagatgtgatgacggattccatgaagatggcaatcgatgagacgatgcgtcgccgtagtgtacaggaggaatataataaagaacatcatatcacaccgcagactgttaaaaaagcggtgcgagatttaatcagtatttccaaatcggttgccgagacagaagaaaaattagagaaagaccctgagtctatgagcagaaaagaattagaaaaattaattaaagaagtcgagaagaagatgcgaaaagcagcggcggatttgaatttcgaggcagcagcagggcttcgtgacaaaatggtggaactgaagaaaaatctggaagaaatggattgatttccgctcgaagtcaagtggatattcgcaatccgctacactgcttgctcataaccaaatagctgctacgcagcttatcagaaggggcttgcccctcctgatacaagcaagtccccacccctgcttattgcttttcgcaattgaagtaggggacttacttgatttggttaaaaaaataaaaaaaatttcgtaaagctcttgacaaataaatgggtcagtgctatcttaagagcatagatgttagcactccactacgacgagtgctaacaattaaaaaagaagcagaaaggagattaaaatggaaagtgaattggatgagcgaaaacgaaaaattttaaaagccataatccagacctaccttgataccggagaaccggttggttcaagaacgatatcaaaatacacagacctgaatctcagttctgcaaccatccgaaatgaaatgtcagacctggaagaactgggttacattcttcagccgcatacatcggccggaagaattccttctgataaaggatatcggttatatgtcgatgaactgatgaaggaaaaagaaaaagaagtttcggaaattaaagatttgatgatagaaaagaccgataaaatggaaaaagtattacagcaggtagcaaaagtacttgcaataaatacaaattatgccacaatgatttccggtccgacctatcacagaaacaaacttaaattcattcagctctctaaagtgggtgacaatcaactgcttgcggttttagtaaccgacagcaatctggtaaagaatcagatgattgatttacaggagcctatgagtgatgaaacagttttaaaattaaatctgcttttaaatacgcagttaaatggtcttacaatcgaagaaatcaatctgagcatgataacccggatgaaagaacaagccggtatccacagtgaagtggttggcagtgtgattgatgcggtagctcaggcgattgcagaagacaaagatgaggttgaaatctatacaagcggtgcgacaaacattttcaagtacccggaactggcagatacctcaaaagccagtgaattgatttcagcatttgaagaaaaacatgcgcttgcagatttagtaaaagattcgatgagttcagaagaaaacacaggaattcaggtttatattggaaatgaaagtccggtacaaaccatgagagactgcagtgtagtgactgcgacttacgacttgggtgagggcatgcagggaacaatcggaatcatcggaccgaagagaatggattatgaaaatgtagtagataatctgaaaacgctgaaaacacaattagaccatatatttaagaaaacatagaaaggcggaatggattcgtgtcagaagaaaaagaattatatgatgataaaaacgatgatgtaacagccgagacagaaacagaagaaaccgaagaagttacagaagaaagctgtgaagcagaagaaaattctgaagaagcagaaacagaagaaaaatctgaagaaaagaaaggatttttcaaaaagaaaaaagataaaaaagatgaaaaaatcgaagagctgactgaccgtgtaaaacgtcagatggcagaatttgataatttcagaaaacgtaccgagaaagaaaaagcttccatgtatgaaatcggtgcaagagaaatcattgaaaagattcttccggttgtagataactttgaaagaggtcttgcagcagttccggaagaagaaaaagacagtccgtttgcagacggaatgacaaagatttacaaacagatgatgactgtatttgaagaaatgggtgtcaaagccattgatgcagtcggagaagaatttaatccggattaccacaacgcagtaatgcatgtggaagatgaagaagccggagagaatgtagtagtagaagagttccagaaaggatatctctataaagaccatgtcgtaagacacagcatggtaaaagtagcaaattaatcaattatatctgatttttaaaatcagatttcatcttataaattgatagaaaacttggaattgatataggaggaaaaaatcatgagcaagattattggtattgacttaggtacaacaaatagctgtgtaggtgttatggaaggtggacagccaactgttatcgcaaatgcggaaggcgcaagaacaacaccatctgttgtggcatttacaaaaacaggtgaaagattagtcggtgagccggcaaaacgtcaggcagttacaaatgctgacaaaacaatctcttctatcaagagacacatgggtacagattacagagtaacaattgatgataagaaatattctccacaggaaatttccgcaatgattcttcaaaaactgaaaggtgatgcagaaaactaccttggtgaaaaagtaacagaagctgttatcacagttccggcgtatttcaatgacgcacagcgtcaggcaacaaaagatgccggtaaaatcgcaggtcttgatgtaaaacgtatcatcaacgagcctacagcagcagcacttgcttacggtctggataacgaaaaagaacagaaaatcatggtatacgacttaggtggtggtacatttgatgtttccgttattgaaatcggtgacggtgttatcgaagtattatctacagctggtgataaccgccttggtggtgatgactttgaccagaaggttgcagattacatgatttctgaatttaagaaagcagaaggtgtagacctttccgcagataaaatggcaatgcagagaatcaaagaagcagcagaaaaagcgaaaaaagaactttcttctgcaacaacaacaaatatcaacctgccattcatcagcatgaatgcaaatggacctctgcacttcgatatgaacctgacaagagcaaaatttgatgaattaacacatgaccttgtagaaagaacagcagaaccggttcgccgtgcattatctgatgcaggaatcaatgcttctgaattgggtcaggtactgttagttggtggttctacacgtatcccggctgtacaggataaagtaaaagccttaacaggaaaagaaccaagcaagagcttaaacccggatgaatgtgttgcacttggtgcatctgtgcagggtggtaaacttgccggagatgcaggcgcaggtgatatccttcttctggatgttactccactgtcactgtctatcgagacaatgggtggtatcgctacaagactgattgagagaaatacaaccattcctacaaagaagagccagattttctctacagcagcagataaccagacagcagtagatatcaacgtagttcagggtgaaagacagttcgcaagagataacaaatcccttggtcagttccgtctggatggaatcccgccagcaagaagaggtgttccgcagattgaagttacattcgatatcgatgcaaacggtattgtaaatgtttccgcaaaagaccttggaacaggaaaagaacagcacatcacaattacagctggttcaaatatgtctgatgatgaaatcgataaagcagtcagagaagccgctgagttcgaagctcaggataaaaaacgtaaagaagcagttgatacaaagaatgatgcagacgctatggtattccagacagaaaaagcaatggaagaagctggcgataaattagatgcaaatgataaaacagcagtagaagctgacttaaatgcattaaaagaaatcctgaatggctgtgcaaacaccgatgagattacagatgcccagattgctgacatcaaagcaggtaaagaaaaactgatgcagagtgcacagaaactctttgctaaaatgtacgaaggtgcacagggagcagcaggtgctcaggcaggtccgggaccagaggcaggtgcaggcgcaggagcaaatgaagcttatggcgatgatgtagttgacggagattacagagaagtataaaattgtcagtaaataaaagatatggggcatggggtgctgacaggcgctccatgcctaaatgtgtgtatagaaaggattaaaaccaatggcggataagagagattattatgaggtgcttggtgtcgacagaggcgcagatgattctaccataaaaagtgcatatcgtaagctggcaaaaaaatatcatccagacgtaaacccaggtgataaagaagcagagaaaaaatttaaagaagcttccgaagcttatgcagtattaagtgatgcagaaaagagaaagcagtatgaccagtttggacatgccgcatttgaaaatggcggtggcggagccggcggatatggtggcttcagcggatttgacggcgcagatatgggtgacatttttggagatatttttggagatttattcggcggcggtggtcgtagaagagcgaataatggtccaatgaagggcgcaaatgtcagagccggagttcgtgttacatttgaagaggcagtctttggatgtgaaaaagaactggatttaaatttaaaagaaacctgtgaaacctgtcatggaacaggtgcaagacctggaacacagccggagacctgtccaaaatgtcatggagaaggtcaggttgtctatacacagcagtctatgttcggaatggttcggaatgttcagacttgtccggattgtcagggaaccggtaaaatcgttaaagataaatgtaccgattgtcatggtacaggatatgtgtccaaacataagaagattcaggtaagtattccggcaggtattgacaatggacagagtatccgtatccgtgataaaggtgaaccgggaacaaacggaggaccaagaggagatttgcttgtagaagttatggtagctcgtcatccgattttccagagacaggatatgaatatcttttctactgcaccaattacttatgcacaggcagcactcggtggagaagtccgcatcagtacggtagacggagacgttatgtacgatgtcaaacccggaacgcagactgataccaaagtccgcttaaaaggaaaaggtgtaccgtcccttagaaataaaaacgtacgtggtgaccattatgttacactggttgttcaggtaccaactaagttaaatgaagaggcaaaagaagcacttcgtaaattcgatgccgcctgcggaaatcgtccaaaagaagaaaaagaagaaactccggaaaagaagaaaaaaggcggatgggaaaaattcaaagaaaccattaaagaaacatttgaagattagtaaaaagagaagaaaatttgtgattgtttcacattttttcttctctttttttcgttgcaatctaaaaaaatttcccttataataggaatgttaaatagataaagtgggagagtttatgagaaaatgggcagcatagtggttctaaagcagatggtgatgatatttgcgctgattatacttggatatttcatgtataaaaggaagtttgtatcagaaatggtgatgaaggatttatcagcaattgttgtaaacatctgctgccccgcaatgattcttgcaagtgtgtttcaggatatgtcagatatttccagaaaaaatgtagggattgtaacgggaattggtattgtgtattatgttctgttgattgtgtttggttatgcatttgtaaagatttttcgggtacagacgaaggaaaaagaagcatatgttttgatgagcacgtttggaaatgttggatttatcggatttccggtatcactcgcaattcttggacataaatcaattttgtatgtggtgatttttaattttctgtataatatttttatctttacatttgggattgcattggtaagaaagggaacagaaggcgataaaaaacagtcctggacagatatttttacacccggttttgtctgttgcatttttgcatttttgatttactggtttcagcttaccgttccggagacgcttcagaatatcgtaacttactgtggaaatgcctgtacgtttctttctatgatggtaatcggagcatctgtagtggggttaaatccgaaaaaaataattgaaaatcgaaagcttatgctatttgaattattgcggtttctggtcttaccggttttaattgcaattttgttaaaaccaattcttccggattatattatgcgtgcaaccattattttaatgttggctcttccaaccggaaatatgccggttatgttagcggaacagtataataaagatgcacatacaatatcagagggaattattttgtcgactgtattatcggtagtgacaataacgattgtatttatgtttgtataagagagtatagataaagtatagataaagaaaggaaagactaactatgaagtggaataaaattactttggaaatcagagaagaagtagaagatattgtcatttccacccttgcagacatcgggcttgaaggtgcggaaattcaggacaaacagccgttatccgaacaggataaaaagcagatgtttgtagatattcttccggatatgccggaagatgatggggttgcatatctgaatttttatctggatgaggatgaagatgtcaatgcaatgcttgaaaaagtaaaggcagaattagaagagttaagaatgtttgtagacatcggttccggaatgattacactttcccagaccgaagacaaagactggattaacaactggaaacagtatttcaagcagttttatgtagatgatatcttgattattccatcctgggaagaagtaaaagaagaagataaagaccgaatgattatccatattgacccaggtacagcgtttggaacaggtatgcatgagaccacacagctttgtatccgtcagttaaagaaatatgtgacaagcgagacagaactgcttgatgtcggaacaggaagcggaattttatcgattgtagcattgaaattaggagcaaaacatgcagtcggaacagaccttgatccttgtgcagttccggcagtagaagaaaataaagaggcaaatgagattccggtagaagcttttgacatgatgattggaaatatcattgatgataaagaagtacaggataaagttggctatgaaaaatatgatatcgtagttgctaatattttagcagatgtattagttccactgactccggttatcttaaatcagatgaaaaaaggtggaatttatattacatccggtatcattgacgacaaagaagaaactgttgtaaatgcggtaaaagcagccggtcttgaagtgttagaggttacacatcagggagaatgggtgtctgttacggccagaaaaaattaaggagcaaaaaatgtatcgtttttttgtagaaccgtctcaggtagaagaaacggtcattcgcatctgtggcagtgatgtcaatcatatcaaaaatgtactgcggatgaaaaccggagaggaaatcctgattagtaccggagagacaatggaatatacgtgctacatcgaagaatttttagaagatgaagttactgcgcatatcatgtatgcacaggaagcaggatatgaactttcttctaaaatctatctgtttcagggacttccaaagtcagacaaaatggaatggattattcaaaaggcagtagagctgggtgtgcatcaggtgataccggtggcaactaagcgagcagttgtgcgtctggagggaaaaaaagaggtaaacaagcagcgtagatggcaggcaatttcggaaagtgcggcaaagcagtccaaacgtatgtatgtgccggaagtcagtcatgtgatgagttttaaagaagcccttgcttatgcaaaaaatctggatgtgattcttttaccttatgagcgtgcaaaagggatgcaggagacaaaagcaatcataaacagtataaaaccaggtcagtcgattggaattttcataggaccggaaggtggtttcgatgaaaaagaagtcgaacagtcaatggatgagggtgcaaaagcaatcactcttggaaaacgaattttacgaacagaaacagcgggattgacagtgctttcagttctgatgtttgctttggaggaataaaataaaatggaagcatatcttgataattcagcaaccacacagtgctttgaagaggtaagagacattgtagtaaaaactatgatggaagattatggaaatccgtctgcaatgcacaaaaaaggcgtggaagcagaacagtatgtaaaagatgcgacagaaaaaattgcaaaaactttaaaagttcaggaaaaagaaatttattttacatcaggcggaacagaatccgataactgggcacttgttggatgcgcttatgcaaatcgcagacagggaaaacacattatttctaccgtgtttgaacatgcagcagtttcagcaccgcttgcagcattagaggaacagggatttgaaataacaaaaattccggttgatgcaaacggaattctttcgatggaaaaactggaatctgcaatccgtccggatacaattttagtttctacgatgtatgtcaataatgaggtaggagcagttgttccggtggaagagattggaaagctggttcatgaaaagaatccgaaaacaatttatcatgtagatgcaattcagggttatggaaaattccgtatctatccaaaacggatgggaattgatttgttatctgtaagcagtcataaaattcatggaccaaaaggagttggatttttatatgtaaatgaaaaaataaaaattcagccgatgattcttggcggtggacagcaaaaaggcatgcgttccggtacagataatgttccgggaattgcagggcttggagtggcagcgaagaagatttatgaagatttcgatgaaaaaattgaacagttaaaggaaaataaactgtatcttgcaaagagacttcaggaactggacaatgtctttatcaatggtccaaaaccagaagatggggcaccgcatattttaaatgcaagctttgtcggagtcagaagtgaggttctgcttcataccttagaagaaaaacagatttatatttcagcgggaagtgcctgctccagccacaaaagagccgcaagtgcaaccatgcttgcacttggagtctcagcagaacgcagagagtccgcaattcgtttcagtctaagcgagatgacaacaaaagaggaacttgattatgcggtagatgaaatcgcaaaagtacttccggtgcttcggaaatttgcacgacattaagatgtaaaagaagttaatgagataaaaaagaataaaagacaatattatgaaatgaaaggaaacgatatgttcaaagcatttttgataaaatatgcagagattgcaattaaaggaaaaaacagatatatttttgaagatgcgcttgtagaccagattcgtcatgtattaaaagaagtagatggcgaattttcagtcgtaaaagagcgtggtcgaatttatgtctatgcagacagtgaatttgattatgatgagacaatagaggcattaaaacgtgtctttggtatctttggaatttgtccgactgtagtattagaggacaaaggctatgaagagttatccaaagaagtggttgcttatgtgaaagagatgtacaaggatgagccaaaaaccttcaaaatggacgtgcgtcgtgcaaagaagagctatccgatgacgtctatggaaatgaacgcacagcttggcggggatgtactggattcctgtccgaatatgaaagtggatgtgcatgaaccggatgtgatgattcatgtggaagtcagagataagatttatctgtattctgaagtaattccgggaccgggaggtatgccggttggaacaaatggaaaagcgatgctgttattatccggcggaatcgacagtccggttgccggatacatgattgcaaaacgtggtgttaagattgatgctgtatacttccatgctccgccatacacaagtgaaagggcaaaacagaaagtcgtagatttggcaaaattagtagcaaaatacagtggaccgattcatcttcatgttgtaaattttacagatattcagctgtatatttacgaaaaatgcccgcatgaagaattaaccattatcatgcgtcgttatatgatgaaaattgcagaagaatttgcaaaaaaagacggttgtctcggattgattacaggagaaagtatcggtcaggtggcaagccagacaatgcacagccttgctgctacaaatgaagtctgcaccatgccggtattccgtccggtgattggatttgacaaacaggaaattgtagatgtggcattaaaaatcaatacttatgagacctcgattttaccgtttgaagactgctgtacaatctttgttgcgaaacatccggttacaaaaccaaatctgaaagtaattaaacgctcagaagagaagttacaggataagattgaagaaatgatgatacaggctgtagagacagcagagacgattgtgtgtgagtaaaatttgcaataataaaataataagagtcatacagaattgtgtggctcttaagatttctttattaatgagtgaaaagcagaaatagaaaaaaggactgttaaaacagtccttggtttctatcatccattttatattagtctactaaatatggttttaagacagtaagaatatcgtctaaagcaccatcagttgcatggatgtttaaatcaatagatttggataaatctaagctgaagatacccatgatagattttgcatcgattacgtatcttcctgatactaaatcaaagtcatagtcaaattttgtgatttcatttacaaatgatttcactttgtcgatagaattcagagaaattttaactgttttcattggacaaatcctcccttacaatcagtgttttttgctttttacaagcataatgttaccgttaatggggcaaaaagtcaatatctaaaagagagaaataaaatacaaataattcggaaactattcgtcaaaacgcttaagaataaataggagtaaaatagaaatatatggaaaagaaagttgcattgcacaatttaggatgtaaagtaaatgcttatgagcttgaagcaatggaacaaatgcttaaaaatgcggggtatgaaattgtaccatttgcgcctggagcagatatttatatcattaatacctgtacggttacaaacattgcagaccgcaaatcaagacagatgcttcataaggcaaagaaaatgaatcctcaggcagttgttgtggcagcaggctgttatgcgcaggcgcaaaaaggagaagaaattgacgaggcaattgatattgtgcttggaaataacagaaagcaggatttgattgccgtgctggaagagtatcaaagcggaaatggtcagaaggaagagagaatagaccttgaaaaaccggtagaatatgaagaactggagctggcttccacaggagagcacaccagagcttatttaaaagtacaggacggatgcaatcagttctgcagttactgtattattccttatgtcagaggtcgtgtcagaagccgtaagagagaggaagtcataaaagaagtagaacgtctggtagcacttggatatcaggaatttgtcttaaccggaatccatttaagttcttatgggattgactgtgaggatagtctgttaaatctgattgtggcagtacagaatgttgagggtgtaaaaagaattcgtctgggttctttagaaccgcgtattattacagaagagtttgtaaagaccttaagcagtctgccggctatctgtccgcattttcatttgtctttgcagagtggatgcacggaaactttaaaacgaatgaaccgtaaatataccgcaggagaatacttagaaggatgtcgtctgcttcggaaatattttgaccatccggcactgacaaccgatgtaattgtaggatttccgggggaaacagaggaagaatttaaatcctctaaggaaatggtgtcagaagctaaattctatgagactcatatttttaaatattcaagaagaaaaggcacaagagcagataaaatggaaaatcagattccggaacaggtaaaagcaagcagaagtcatgagatgattgagcttggaaaagcacatcagaaagaatatatggaatattatcttggaaaacaggttgagattttatttgaggaaacaaccgagattaatggacagacttactgggtcggtcatacaagagagtatataaaagttgctgttttatcagaaaaaaatctggagaatcagcttgtaacaggagaaattaccgaatttcttcaggatgggatttttaactgccgaatataatggttgaatttcctagaaagatatattaaaatagtggtaaagttttagataagggcgtgataatatgggaaatttagatagtacacaatattttaatgtaaaaggcgatccggaaatcagagtaaaagatgttttggatttggtatacaatgcgatggcagaaaaaggatataatccggtgaatcagattgtcggatatattatgtcaggagacccgacttatattacgagctacaagggagcaagaagtacaattatgaaagtggagcgcgatgaacttgtagaggaacttttaaaagaatacattaaaaatgagtcctggaagcacgagtaagattatgagagtgatgggactggattatggctctaagactatcggggtggcaatcagcgaccctttaggtcttacagcgcagggaattgaaattattcgtcgggaagaagaaaataagttaagaaaatcccttcgccggatagaagaactgattaaggaatatcaggtagaagaaatcgttctgggatttccgaaaaacatgaacaatacaattggagaacgggcggagaaatcgctgcagttaaaggaaacactggaaagaagatgtaaactgccggtaattatgtgggatgagagactgacaactgttgaagcaaaccgtacactgatggaaagtaaagtgcgcagggagaacagaagtaaatatgtggatatgattgctgcagtatttattctgcagggatatctggattcaaaagcaaacccgggtacagtttaatttcggttaaaatgccagaaatggtatttttaagaaaaaaagaaacggctgttatccgggattttagcgtataaaaaaataaattacgataagaaaggatgaggttatggaaacaattatttttgatggagaggacggaagtcagattgaacttggagtcgttgcgcagacaagagtaaatggaagtgtttatttgctgacagtagacccggaagagtccggtgaagaaggcagtgcagcttatattttaaaagatacctcagaagatggagacaaggacggctgttatgtatttgtagaggatgacacagaatttgatgcagtgtataaagtctttgaagtgatgttggatgagattgattttgaatacgaataataaaaggaacggcaaaaattggaggaattaatttgaaaaaaaacaacaactcaaaattgaaaatcattccattgggcggactggaacaaattggaatgaacattacagcctttgaatatgaggatagtattgttgtagtagactgcggactttccttcccggaggacgatatgctgggaattgatttagttattccggatgtcacctacttaaaagaaaatatttccaaagtaaaaggctttgtaattactcatggtcatgaagaccatatcggagcacttccttatgtattaaaagaagtgaatgtgccgatttatgcaacaaaacttaccatcggactgattgagaataaattaaaagaacacaatctgatccgtacaaccaaacggaaagtgattcgtcatggacagtccattaaccttggctgtttcagaatcgaatttattaaaacaaatcacagtattcaggatgcttctgcactggcaatctactcaccggcaggaatcgtcgtgcataccggtgactttaaagtggattacactcctgtatttggggatgcaattgatttacagagatttgcagagattggaaaaaaaggtgtccttgcgttgatgtgcgacagtacgaatgcggagcgaaaaggctttacgatgtcagaacgtactgtaggaagaacatttgacaatatttttgcggagcatagaaatacaagaattattattgcaacatttgcctcaaatgtggatcgtgtacagcagattatcaactcagcctataagtatgggagaaaagttgcggtagagggccgaagcatggtaaatgtcatcggtacagccgcagaacttggttatctgaagattccggataaaacgttaattgatatcgaccagcttaaaaactatccggatgagaaagttgtattgattacgacaggaagtcagggagaatctatggcggcattgtcccgtatggcagcaagtattcataagaaagttacgattaagccaaacgatacgattattttcagttccaatccgattccgggaaatgaaaaagcagtatcaaaggtgattaatgaattaagtatgaaaggtgcagacgttatctttcaggatgcacacgtttccggacatgcatgtcaggaagagattaaactgatttattcccttgtaaaaccgaagtatgccattccggtgcatggagagtacagacacttaaaagcacaggcaggtgtggcagaagaacttggaattccaaaggaaaatatctttattctttcttccggtgatgtgcttgaactaaatgaagaagaaccggcaagagtaaccggacaggttcgtacgggagcaatctttgttgatggtcttggtgttggagatgttggaaatatcgtacttcgtgatcgtcagcatctttctgaagatggtattatgattgttgtgcttactttagaaaaacattcgagcaatcttctcgcaggaccggatatcgtatcacgtggttttgtctatgtgcgtgaatcggaagatttaatggaagaggccagaagtgtagtggaagaggcgattgacagctgtctggagagacatattacagactggggcaagatgaaaaatgtgattaaagattctctgggagaattcttgtggaagagaaccaagagaagtccgatgattttgccgattattatggaggcataattccatgagtaatattgattattatgtaaacagggtgattgaggagattaaaagtgagagtgtttacagacaatacacgacttctcttgaaaagcttaacgcaaatcctgagataaaacggcaggtcgatgaactgcgcagattaaactatcaggcgcaggtaaaaaatgatgatacagactcttatgacaccatagatgacattgatgataagataaatgaattaagctgtataccggaagtgaatcagtttttagaggcagaagctgcactttgcagactcctgcaggatatttcggtaagagtacatgaggcgattcatttagatgtaccggacttgaattaggggaatgcttatcggcattcaattggcaggattagcaggagactttaatattccgagggtgcattaagaaaataaggagaaaaaaatgggaagaggaatcagaaaacagggtgcggcatcaatttttgcaggtggatttttccgctttgctgtgtatgcctgtgtggtgtgtgccgtgatttatgttggaaaatcagcgtatgattttggatatgcgattttcgaccagatacctgtggatgatgaagaccatggagaagatgtaactgttgtaatcaaagacggagcgtcggtgtatcagattggaaagattttaaaaagcaaaggtctgattaaagatgcaaaagtatttgtggtacaggaaagtctttcaaattataaagataaattacagtcgggaacttatattttaaatacttctatgacgacagatgaaatgctggcagtgcttgcaagagaagatatgacaggacagccggagcaggattccacggattctctggacacttcagcggatggcacagatgtgcagacaacagaagagtccgttacagatgagagtcaggatgcgtcaggagaacaggcaggagaaacggctgaataagagggaaaaaaagtgattgttgatgaaagaatggttacctatataaactctctggacaaaggaaatacgccttttttgactcagcttgaaaaggatgcaaaggaaaattatgtgccgattatacggcgggaaatgcagagctttttaaaagtaatgctacagatagcaagtccccatctcatcttagaggtggggactgctgttggtttttccactcttcttatgagtgagtatgcaccgaaagactgcagaatcacgacgatagaaaattatgagaagagaataccgattgccagagaaaattttaaaaaagcaggaaaagaagagcagattaccttattagagggggatgcggccaaaattttaaagacgctggagggaagttatgattttatctttatggacgcagcaaaagcgcagtatattaacttctttccggatgtgctgagacttttgaaaaaaggcggaattttgatttctgataatgtactgcaagatggagatattatcgaatctcactttgcggttgagagaagaaaccggacaatttataagcggatgagggaatacctttatgtgctgaaaaatcatgaagaacttgagacaagtattattcctctcggtgatggagtaacgcttagtattaagaaatagaaaggcaggaaagatgagagcaaaaccagagttattaattccggcaagcagtctggaagttttaaaaatagcggttatttttggtgcagatgcagtttatatcggtggagaagcctttggactgcgtgcaaaggcaagaaacttttctatggaagacatgaaagagggaattgaatttgcacatcagcaccatgtaaaagtatatgtaacagcaaacattttggcacacaacaaagatttggacggagtaagagaatatttccgtgaattaaaagaaatcaggccagatgcactgattatttctgacccgggtgtatttatgattgcaaaagaagtatgtccggagattgaacgtcatatcagtactcaggcaaataataccaattatgaaacttataagttctggtatggactgggcgcaaaacgtgtggtcagtgcaagagaactttctttagaagagattaaacagattcgtgcaaatattccggatgatttggaaatcgaaacttttattcatggtgcaatgtgtatttcttattccggaagatgtctcttaagcaatttctttaccggaagagatgccaatcagggtgcgtgtacgcatccgtgcagatggaaatattcgattgtagaagaaaccagaccgggagaatacatgccggtttatgaaaacgagcgtggaacttatatctttaactcaaaagatttatgtatgattgagcatatggatgatattctgacttcaggaatcgacagcttaaaaattgaaggacgaatgaaaactgccctttatgtggcaacggttgcaagaacctacagaaaagccattgatgattattttgagagtccaaaattataccgggaaaatatggaatggtataaagagcagattatgggctgtacctatcgtctgtttaccaccggatttttttatggaaagccagatgaaacttcccagatttatgacagtaatacttatgcaaaagactacacatatcttggtttcttggaagaaaagacagaaaaaggactctatcgaatcacccagagaaataaattccttgtaggagaaacgatagaggtcatgcgtccggatggagaaaaccgtctggttacggtaaaagcaatctatgatgaagagggaaattcctgtgatagtgctccgcatccacagcaggtgctgtatctggatttgggagaagatttaaatgtctttgaccttttaagaagaaaagaaagcgtttcttaactttaaaatcgcatttttttcaatacgggacacataagagcggctgatattcagccgctttgctatttcccgctgggtcagctcatcacagccataaagcccaaagcgtagttttaagacttccgcttcccgtttggtcagtacgaaaccgagcaggtagtaaagtttacggatatcctgttttaaagaataattttttacgacatcgacaggctcattttcaatcacatcaagcagattgatttcatttccttcacggtctgtaccgattggctcataaagagaaatatctttgctggttttctttttagaacgaagcagcataagcagttcattgtcgatacagcgggcagcataagtggagagccggttggatttttcctgattaaatgtatgaattgcttttatcagaccgattgttccaatcgaaatcaggtcatctaattcttcttcaaccccttgatatttttttacaatatgtgctacaaggcgcagattgcgttcgatgagaacattttttgcttcctgactgccccttttgtattcttggagataatatttttcctcctcggatgtcaagggcttaagaaatgttttcaagcagccttacctcaaagggatttaataatagtctatgagaaaaagggataaattgtgcttttccaaaaaaagaaaaaatgtttgtatcaaaaggaaaattgtgatacgataatcgaatcagaaaacaattcatgttttccggtacagctgcttaatcttcgctgtaccagttctggcagttctgccgttttttcaaattttaaatttatttaatttcaaatctaagacaagtaattatgagtttaggaggcattttatgtatgttcagtaaagtgttgtcagcggctattgatggggcaaggtgcgttccggtatcagtagaagtggatgcaagtaatggacttccggcttttttgatggtaggagatttatcttatcaggtaaaagaagcgcaagagagagtccgtactgcgataagaaacagtggaatgacaattccacccaaaagagtaactgtaaatttagcacctgcggatgtccgtaaagatggaaatcattttgatttgccaatagcggcttcgcttatgattgcatttggctttctggaagcggaaaaattcgatggcgtgatgcttgccggagaacttggcttaaatggcaggattaatggagtcagaggaattctgccttttgtagaaaccgcttacaaaaagggatgtcggctttgtattgtgccaaagcaaaattacagggaagcacggatgattggacagatttctgtgcttggagtggagtctttgcaggaatttttaagctgtgccagaaaagaaaactgggggcttttagaagatacaaaagaagagccggttttattgcctgcaaagaaagaagaaatcgaagattttgctgatattcaaggtcaggaatatgtgaagcgggcagccgtgattgcggcagcagggatgcataactttcttatgaccggtccaaagggaacaggaaagacgatgattgccagaagaatcccagggattctgccagaacctaccaaagaagaactgcttgaagtatcaaagatttacagcatttcaggtctgttatccgaagagaaaccgtttcttttatctcgtccatttcgggcaccccatcacaccatttcaccggcagcacttgccggaggtggaaagtatccaaaagccggagaaatcacgcttgcccataagggcgttcttttcttagatgaatttccggagttttcccatgaatgtattgaattattaagacagccgttagaagaacggaaaattttaatcagccgaagcggaggttcgtacttgtttccggccgattttatgctggttgctgcaatgaaccactgtccctgtggtcagtttccggatttaaatcggtgcagttgtacgtttcaggaagtaaagcgttatcagaatcgaatcagtggtccgattttagacagaattgatattgtggcagaagtgtcgggaatttcttatcaggaactgaccggaaaacggaaagaaaaaagttcaaaaaaatttagaaaagaagttgagatggcagtaaaggtacaaggggaacgctatcaggagaaaaagattcggtttaattctcagctttccggtaaattattggaggagttttgcaatgtaagtgcagagggacagcgaattttggaaaaagcgtataaaaaaatgagattaagtgcaagggcatatcataaaatcttaaaaacggcacgtaccattgcggatttggaacaagaagaggagataaaagaagcgcatatcagtgaagcactttgttatcgaagagtagaaggaaaggatacttgaaatatggaagaaaaaattgtaagttatacaccggatgacgttgagtatccggataaattaagaaattttaaagacagacccaaacggttgtatgtaaaaggaaaacttccggatccaaatcgcaaaagtgtggcgattatcggggcaagaatgtgcagttattacggcagaacgcaggcttatgaatttgcaaaagaatttgcttcttgtggagttcaggttatcagcggactggcaagaggaattgatggctgggcacataaaggtgcaattgatggcggaggagaaacatttgcggtgcttggttgtggagtggatatttgttatccgagccagaatatcaatctctatcgtgagattcagaaaaagggaggaattatctctgagtatgaggaaggagagaaaccccttggatggcattttccgttaagaaatcgaattatcagtgggcttgctgatattgttttagtaatcgaggcaaagaaaaaaagcggttcattaattacagtagagtatgcacttgagcagggaaagtctgtctatgcgcttccgggaagagtgggggaagcattaagtgaaggatgcaacaatttaatttttcagggagcacaaattgcaaaaaatgtggaaattatcctcgaagaactcgaaattttggataaaatgacgaaagaaaagaataaaaaaacagagataaggcttgcaagaaaagaagaaatggtgtatagttgtgtggatttgaaaccaaaacacctggacgaaattataaaattgactgacttggaattgcttgaagtgcaggaaattttggtgaaattagagttgatggaacttgtaacagagccaataaagaattattatgccagagcgggaggttgatatggcaaagtatttagtgatagtggaatcgccggcaaaagtaaagacaataaaaaaatttttaggttccaattatgaagtcatggcatcaaacggacatgtaagagatttgccgaaaagccagttggggtttagtgtagaaaatgattatgaaccaaagtatataacaattcgcggaaagggtgacattttagcagcacttcgaaaagctgcgaaaaaagcagataaagtttatcttgcgactgaccctgaccgtgagggagaagcgatttcatggcatctttcaaaggcattgaagttagatgataaaaaaatgcgtcgtattacctttaatgaaattacaaaaacagcagtcaaagcttctattaaagaggctagagagattgatttaaaattagtggatgcacagcagaccagaagaatgttagaccgtatggttggatatagaatcagtccggttttatgggcgaaagtaaaacgtggattgagtgcaggacgtgtgcagtctgttgctcttcgtattattggagacagagaagaagaaatcaatgcatttataccggaggaatattggactttagaggcacagtttgcggtaaaaggtgagaaaaaaccgctgactgcaaaattttatggaaaaaaaggacagaaaatcaatattcattccaaaggagaactcgatgaaattttaaaaaaccttgagggtgcaagctatgaggtggatgaagtaaaaaagggagagcgtaccaaaaaagcaccatttccatttactaccagtaccttacagcaggaagcctccaaagtgttaaacttctcgacacagaaaaccatgcgtcttgcacagcagttatatgaaggaattgatatcaagggaaatggaacagtcggtgtgattacttatctgcgtacggattcaacccgtatctcggatgaagcccagaaagcagcacaagagtatattacagaacagtatggagaagaatataccaaagtaactgagaaaaaagatagtaataagaagaaaattcaggatgcgcatgaagcaattcgtccaaccgatattacaagaaccccgatttctttaaaagagtctttaaccagagaccagttccgtctgtatcagttaatttggaaacgttttaccgcaagtcagatgcagcctgcaaaatatgaaaccacttccgttaaaattaaaggcggagagtattattttacaacatctgcatcgaaattaaaatttgatggtttcatggcagtttatgtgcaggaagatgatgaaaaatcagataagacggttttgacaaaagggctcgatgagacgagcgagttgacatttgagaaatttaacgaacagcagcattttactcagccaccggctcattatacagaggcgactcttgtaaaaacattagaagaacttggaattggacgtccaagtacctacgcaccaaccattactacgattattgcaagacggtatgttgcaaaggaaaataaaaacctttatatgacagaaattggtgaagtagtcaataatattatgaaaacttctttcccaagtattgtagatgtacattttacggcaacaatggaagaactgctcgatagtattgcagaaggattgattgagtggaaaacggtaattcgcaatttctatccggatttggatgaggcagtaaagacagcagaaaaggaacttgaagaagttaagatagaagatgaggtaaccgacgtaatctgtgaacagtgcggaagaaatatggtaatcaaatacggaccgcatggaaaatttctggcttgccctggatttccggaatgtcgtaataccaaaccatatctggaaaaaatcggagtaccgtgtccaatctgtggaaaagaagtagtaatgcgcagaagtaaaaaaggacgccgttattatggctgtgaaaacaatccggaatgtgaatttatgtcctggcagaagccatccaaagaaaaatgtccaaactgcggtggatatatggtagaaaaaggaaacaaactggtctgtgcaaatgaacagtgtggatttgtaaaaatacagccgaaagacaaaggcgaagaggcttaaataaaaatccaagtaaagtggacatttgtggaataaaaacaatgaaaataaatggttaatttagggcgattgcaggaaaagtcttgtagtcgctctttttggtgaaagaaacgaaattgttagaaaaaaatgaatagacagaaaatagctatattatccattgatttcagaataattgtgtggtaaaatgaaaaaaggaaaaataaatgtaatatataggattggatgctgaacaaaacgaaaggagatttattatgagcgtacaattactagacaagaccagaaaaattaataaactgctccataataatcattcttccaaggtattatttaatgatatctgcgaggtgatggtagagactctggactccaatatacttgttatcagtaaaaaggggaaagtacttggtgtcggaacatgtcagggagtgcaggagattacagagctaattgacgatgaggtcggcggatttattgataagctcttaaatgaaagactgcttggagttttgtcaacaaaagaaaatgtcaatttacagactcttggatttgaaagcgaaggtattgataagtatatggctattatcagtccgattgatattgcaggagaacgtttaggaacactctttatgtaccgtgataccaaaagttatgatatagaagatattatcgtaagtgagtacggaacaactgtggttggtcttgaaatgatgcgttccgttcatgaagaaaatgcagaagaaaatcggaagattcaggtggtaaaagcggctttcaatacactgtcattctcagagttggaggcaatcattcatatctttgatgaactcgacggagatgaggggatcttagttgcaagtaagattgcagaccgtgtgggaattacaaggtctgtgattgtaaatgcacttcgtaagtttgaaagtgcaggagttatcgaatctcgttcttccggtatgaaaggaacctatattaaagttttgaatgaagtgatttttgatgaactcgatgaaattaaaaaaagaaaaatcgtgaagaataataaatagaaataataaatagaatagaaatgaatgaatcaagaatagaaagtgaagagacttcatatagtaagagggaacttgactttctatttttttatttacagaaaattactttcctgtaaataaaaaaacgctccgcggggatgcgcactgcggcgtacaaagtagatgtcacaagcgaccaccgcaggcgcgagaatgtgccttgccacattctctattttgaatttataaaaattgtatgaaacatgtacaaaaataaaaaaataagaaaacataagaaaaaatgagaaaacataagaaaatatcatgaaatataaaatattacacattttgttgcagttgcggaaataagctgaattaactaatatatgactaacggttagcactcgattaaaatgagtgctagtaaaatgagattgataattctaaaggaggcattttagatatgaaattagtaccattaggagacagagttgtattaaaacagttagttgcagaagaaactacaaaatccggtatcgtattaccgggtcaggcacaggaaaaaccacaacaggcagaagtaatcgctgtaggtcctggcggagtagttgatggaaaagaagtgaaaatggaagttgccgttggagatcaggttatctattccaaatatgccggtacagaagtgaaattagacggggaagaatacattatcgtaagacagaacgacattcttgccgtagtaaaataaataagaaattataattcttaaaaatcgtaattctcaaaaatcaggaggaaaaaagtaatggcaaaagaaattaaatatggagcagaagcaagagcagctcttgaaaatggtgtaaataaattagcagataccgtacgtgtgacattaggaccgaaaggaagaaacgttgtattagacaaatctttcggtgctccgcttattacaaatgatggtgttacaatcgcaaaagaaatcgaattagaagacggttttgaaaacatgggtgcacagctcattaaagaagttgctgctaagacaaatgatgtagccggtgatggtactacaaccgcaactgtactggctcaggcaatggttcatgaaggaatgaaaaacctggcagcaggtgccaacccgattatcttaagaaaaggtatgaaaaaagcaactgcaaaagctgtagaagcaattcaggcaatgagcggaacaattgaaagcaaagatcagattgcaagggttgcagcaatttctgccggtgatgacgaagttggtgaaatggtagcagatgctatggaaaaagtaagcaatgacggtgttatcacaatcgaagaatccaaaacaatgaaaacagaactggatttagtagaaggtatgcagtttgacagaggatatatttctgcatatatggcaacagatatggacaaaatggaagctgtattagatgatccatatattttgattacagataagaaaatttctaatatccaggatttacttccggtattagagcagattgtaaaatccggtgcaaaactgttaatcatcgcagaagatatcgaaggagaagcgctgactactcttatcgtaaacaaattaagaggaacattctctgtagtagctgtaaaagctcctggatatggcgacagaagaaaagaaatgcttcgtgatatcgcaatcctgacaaatggtacagttgtatctgacgaactgggtattgaattaaaagacgtaacgatggatcagcttggacgtgcaaaatctgttaaagtacagaaagaaacaacagttatcgttgatggtgaaggttctaaagaagatatcgaagcaagaatcgctcagattaaacatcagattgctgaaacaacatctgaatttgataaagaaaaattacaggaaagacttgcaaaactttccggtggagttgctgttatccgtgtaggtgctgcaacagaaacagaaatgaaagaagcaaaacttcgtatggaagatgctttaaatgcaacaagagcagctgtagaagaaggtattatcgcaggtggcggttctgcttatatccatgcatcgaaagaagttgcaaaactggttgaagaacttgacggcgatgaaaaaacaggtgcaagagtggtattgaaagctctggaagctcctctgttccatatttctgcaaacgcaggtctggaaggctctgttatcatcaataaagtaagagaatctgaagttggtgttggatttgatgcattccatgaagagtatgtaaatatggtagaaaaaggaatccttgacccgactaaagttacaagaagtgcattacagaacgcaacaagtgttgctggaactctgttaacaacagaagcagttgtttctacaatcaaagaagagactcctgcaatgccagcaggtaatccgggaatgggtatgatgtaatttaaccaaagcggattgcgaatatccgattgacattttaagaaattcttatgccggtgtcagctagacaccggcatttctttatgatagactaaaagagataagaaaaaatgcatgaaaatgcacgaaaaaacgaaaggagaacgaagtgaacgacacatattcagaacttctgataaaaaaagaagtaactgcaaaagacaagatgataaaagtgcttctgattgcactgattgcacttatggcagttgccggaattttaattacaccgcttgcatttattgcagcgattgcgcttggaattgcagcctattttgtgtttccgaatctggatttggaatttgagtatgtctatgtaaatggagaactcgatattgacaaaattatggcgaagatgaagagaaaaagagccaaaagttttgaactttccaaaatggaaattatggcgccggtaaaatcccatagactggattatcagaaccagaataccagaatgaaagtttatgatttttcatcaggaaatccatcacataaagtttttgcgatgattattcctagtgacaatgaactctgtaaagtgttgcttgagccggacgaagaacttttaaaaaatattgaaaaaagttgtccgagaaaagtttttgtggattgacacttttgtcggaatttgttatattttattactataaacaaaatgaagggagaaagacaatgggtaagattattggtgaaggcattacctttgacgatgtactcttagtaccggcttattctgaggtgattccaaatcaggttgatttaacaacttatctgacaaaaaaagtaaaactgaacattccgatgatgagtgcaggaatggatacggttacagaacatcgtatggcaattgctatggcaagacagggtggaattggtattatccacaaaaatatgtcaattgaagcacaggcagacgaagtagataaagtaaaacgttctgaaaatggtgttatcaccgacccgttttatttatctccagaacatacactggaagatgcaaataatcttatggcaaaattccgtatttcaggtgtgccaatcacggaaaacggaaaattagttggtattattacaaaccgagatttgaaatttgaagaagatttcagcagaaaaatcaaggaatgtatgacatccgaaaatcttgtaacagcaagggagggtgttacactggaagatgcaaagaaaatccttgcaaaatccagaaaagagaaacttccaattgtcgatgagaatttcaatttaaaaggtcttattaccattaaagatatcgaaaaacagattaagtatcccttatctgcgaaagatgcacagggcagactgctgtgtggtgcagcagtaggtatcacagcaaacgttatggctcgtgtggatgcacttgtaaaagcaaatgttgacgttgttgtcgtagactctgctcatggacattctgcaaatattttaaaagcagtccgcgaaatgaaagaaaaatatccggatttacaggtaattgccggtaacgttgcaaccggtgcagcaacaaaggctttaattgaagctggtgttgacgctgttaaagttggtatcggtcctggttctatctgtacaactcgtgtcgttgcaggtatcggtgttccgcagattactgcagttatggactgttacgaagcagcaaaagaatatggtatcccgattattgcagacggtggtatcaaatactcaggcgatatgacaaaagcaatcgcagccggagcaaacgtatgtatgatgggaagtatgtttgccggatgtgatgaaagccctggagattttgaattatatcagggaagaaaatataaagtatatcgtggaatgggctctattgcagcaatggaaaacggaagtaaagaccgttatttccaggaaaatgcaaagaaattagttccggaaggtgttgaaggacgtgttgcatacaaaggacatgttgaagatacagtattccagttaatcggtggacttcgttccggtatgggatattgtggagcaaaagatattgaaacattaaaagcaacaggacgttttgttaagattactgctgcgtctttgaaagaatcacatccacatgacattcatatcacaaaagaagctccgaactacagcgtagatgacaaataatacaaaagagtttcagatgtaaacataaacggcaggagctgttgtctttgggcaatggtttctgccgtttttggcattggggagagttttttatgaaacgaaagaaaaaaagaatcagaacaagatggaatataaaggtattcgttatttatgcagtgactttatttttcattatttttggggtaaaaactgcggttgttaagattgcagaattgatacagggcagagtagaagcacagtctcaggaagagacagatgtaacggcagaagaagaaacggaaaaaaacgcagactttccgggagcgccaccgtttacagttgatttgctcgatatcaatgaatattcaagacccgggattgcacttgaaaaaatcaatggaattgtaattcattatacggcaaatccaaagagtactgcaaaacagaacagggattattttgaagggttaaaagacagccatgagacaaaggcaagcagtcattttgtagtgggaataaaaggagaaattgttcagtgtattccaagttcagagatttcgtatgcttctaattcgagaaacagtgataccctttcaattgaatgttgtcataaagataagagtggaaaatttacaaaagagacctatcagtctttagttgaattagttggatggctttgtcagagatttggacttaccagtgagcaggtgattcgtcattatgatgtgacaggaaagaactgcccgaaatattttgtagaacatgaagatgagtgggaacagtttaagaaagatgtagatgttcagattgcagttgtggaacaggaagtagaaactgccagtcaacagtaaatttggatttgaaaggaaagatttaagatgaaaaagaaaaaaattttacagcgggcagttacctattatcgttctcacatgtggtgttctcttttggtttcgatttttggcatgatttttatcattgctctgattttattgggatatatgaagagcaaatattatcagtatctgctcgatacgacttatgaatcagagaaagtgatgatagagtccgttaagaaaaatattgaaaatcagatggagtcctttattgatttgggggcaaatattgcagtggaggaccggcttgtacaggaaattgaagactatgtacaggcaggaaagaccaatcagtatgcttctaagctgatgcggacaactttaaaaagtacaacttatggaagcggttccattaccggagttgcagtaattgaagaagatggtctgcttgcgcagttttccagagaagaagtgggcacagaaaaagtcaggggaatctgggatgaaaataatcaggatgagattataagtctgtttcaggagatgaaacaacataatgagacagggcttctgccccgctatattattgtaaacggagcaaatgaacatttgaatgtgtctggaagaggagtcttacatatcgcatttccgattaagaatggctataattataaaaatatgaaatacatgattatcgtttcttattacagtcagccaatttcatctttgttaaaacagctttctcaggggggaaaagatgagtttttacagggatatattgaaaatgccagtggaaagattttgtttcataccgacgaaaattatgtggataaaaacgcaaaaaagatttataatagtgacacgaataaaatcaatctggaaacggatgtggaaaattatggatggaagctgcatggtgtgattgacaaagctgctttagagtcaaacgtaaacaaaatgtactctaaggcgatgattttgtatttgtgtgcgattttggccgtaatggggattgcaatttttattattaagt

(The sequence listing continues in the following parts.)

The invention claimed is:

1. A method comprising: administering to a subject a pharmaceutical composition that comprises the *Blautia stercoris* bacterial strain deposited under accession number NCIMB 42381; wherein the administering is effective to reduce a level of IL-17A in the subject relative to a level of IL-17A in the subject before the administering of the pharmaceutical composition to the subject.

2. The method of claim 1, wherein the *Blautia stercoris* bacterial strain is lyophilised.

3. The method of claim 1, wherein the administering is effective to reduce a level of an additional cytokine that comprises IL-17B, IL-17C, IL-17D, IL-17E, IL-17F, IFN-γ, IL-10, IL-6, or TNFα, in the subject relative to the level of the additional cytokine in the subject before the administering of the pharmaceutical composition to subject.

4. The method of claim 1, wherein the subject has a condition that comprises uveitis; multiple sclerosis; neuromyelitis optica; psoriasis; systemic lupus erythematosus; celiac disease; an asthma; allergic asthma; neutrophilic asthma; chronic obstructive pulmonary disease (COPD); scleritis; vasculitis; Behcet's disease; atherosclerosis; atopic dermatitis; emphysema; periodontitis; allergic rhinitis; or allograft rejection.

5. The method of claim 1, wherein the subject has uveitis.

6. The method of claim 1, wherein the subject has asthma.

7. The method of claim 1, wherein the subject has arthritis.

8. The method of claim 7, wherein the arthritis is rheumatoid arthritis, osteoarthritis, psoriatic arthritis, spondyloarthritis, ankylosing spondylitis, or juvenile idiopathic arthritis.

9. The method of claim 8, wherein the arthritis is rheumatoid arthritis.

10. The method of claim 7, wherein the method reduces joint swelling.

11. The method of claim 1, wherein the pharmaceutical composition further comprises a pharmaceutically acceptable excipient, diluent, or carrier.

12. The method of claim 1, wherein the *Blautia stercoris* bacteria strain is present in an amount that comprises from about $1\times10^6$ to about $1\times10^{11}$ CFU/g of the *Blautia stercoris* bacterial strain with respect to a total weight of the pharmaceutical composition.

13. A method of treating rheumatoid arthritis in a subject, comprising: administering to the subject a pharmaceutical composition that comprises a the *Blautia stercoris* bacterial strain deposited under accession number NCIMB 42381; wherein the administering is effective to reduce a level of IL-17A in the subject relative to a level of IL-17A in the subject before the administering of the pharmaceutical composition to the subject, thereby reducing inflammation associated with arthritis in the subject.

14. A method comprising administering to a subject a pharmaceutical composition that comprises the *Blautia wexlerae* bacterial strain deposited under accession number NCIMB 42486 wherein the administering is effective to reduce a level of IL-17A in the subject relative to a level of IL-17A in the subject before the administering of the pharmaceutical composition to the subject.

* * * * *